US011434259B2

(12) United States Patent
Bremel et al.

(10) Patent No.: US 11,434,259 B2
(45) Date of Patent: Sep. 6, 2022

(54) MODIFIED ZIKA VIRUS NS1 PROTEIN WITH REDUCED CROSS-REACTIVE IMMUNOGENICITY

(71) Applicant: IOGENETICS, LLC, Madison, WI (US)

(72) Inventors: Robert D. Bremel, Hillpoint, WI (US); Jane Homan, Hillpoint, WI (US); Michael Imboden, Madison, WI (US)

(73) Assignee: IOGENETICS, LLC, Sun Prairie, WI (US)

( * ) Notice: Subject to any disclaimer, the term of this patent is extended or adjusted under 35 U.S.C. 154(b) by 0 days.

(21) Appl. No.: 16/072,357

(22) PCT Filed: Jan. 25, 2017

(86) PCT No.: PCT/US2017/014852
§ 371 (c)(1),
(2) Date: Jul. 24, 2018

(87) PCT Pub. No.: WO2017/132210
PCT Pub. Date: Aug. 3, 2017

(65) Prior Publication Data
US 2019/0031722 A1 Jan. 31, 2019

Related U.S. Application Data

(60) Provisional application No. 62/405,484, filed on Oct. 7, 2016, provisional application No. 62/372,110, filed on Aug. 8, 2016, provisional application No. 62/350,881, filed on Jun. 16, 2016, provisional application No. 62/321,375, filed on Apr. 12, 2016, provisional application No. 62/306,264, filed on Mar. 10, 2016, provisional application No. 62/292,964, filed on Feb. 9, 2016, provisional application No. 62/290,616, filed on Feb. 3, 2016, provisional application No. 62/286,779, filed on Jan. 25, 2016.

(51) Int. Cl.

| | |
|---|---|
| ***C07K 14/005*** | (2006.01) |
| ***A61K 39/12*** | (2006.01) |
| ***A61K 39/00*** | (2006.01) |
| ***C07K 14/18*** | (2006.01) |
| ***C07K 16/10*** | (2006.01) |

(52) U.S. Cl.
CPC ............ *C07K 14/005* (2013.01); *A61K 39/00* (2013.01); *A61K 39/12* (2013.01); *C07K 14/1825* (2013.01); *C07K 16/1081* (2013.01); *C07K 2319/02* (2013.01); *C07K 2319/21* (2013.01); *C07K 2319/30* (2013.01); *C12N 2770/24122* (2013.01); *C12N 2770/24134* (2013.01); *C12N 2770/36134* (2013.01); *Y02A 50/30* (2018.01)

(58) Field of Classification Search
CPC .. A61K 39/12; C07K 14/1825; C07K 14/005; C12N 2770/24122
See application file for complete search history.

(56) References Cited

U.S. PATENT DOCUMENTS

2013/0330335 A1 12/2013 Bremel et al.

OTHER PUBLICATIONS

Bailey, M. J., et al., Jul. 2019, Human monoclonal antibodies potently neutralize Zika virus and select for escape mutations on the lateral ridge of the envelope protein, J. Virol. 93(14):e00405-19 (pp. 1-17).*
Sourisseau, M., et al., Dec. 2019, Deep mutational scanning comprehensively maps how Zika envelope protein mutations affect viral growth and antibody escape, J. Virol. 93(23):e01291-19 (pp. 1-17).*
Asif, A., et al., 2017, Zika virus: Immune evasion mechansims, currently available therapeutic regimens, and vaccines, Vir. Immunol. 30(10):682-690.*
Halstead, S. B., Nov. 2017, Achieving safe, effective, and durable Zika virus vaccines: lessons from dengue, The Lancet 17:e378-e382.*
Britto, C., et al., 2018, Rapid travel to a ZIKA vaccine: Are we heading towards success or more questions? Exp. Opin. Biol. Ther. 18(11):1171-1179.*
International Search Report & Written Opinion, International Patent Application No. PCT/US2017/014852, dated Jun. 9, 2017, 19 pages.
Freire et al. Spread of the pandemic Zika virus lineage is associated with NS1 codon usage adaptation in humans. BioRxiv, Nov. 25, 2015, pp. 1-8.

* cited by examiner

*Primary Examiner* — Jeffrey S Parkin
(74) *Attorney, Agent, or Firm* — Casimir Jones S.C.; J. Mitchell Jones

(57) ABSTRACT

The present invention relates to vaccine compositions and therapeutic interventions for treating and preventing infections and diseases caused by flaviviruses, including Zika, dengue, and Usutu virus. It also relates to compositions and methods for diagnosis and differential diagnosis of flaviviruses and co-endemic pathogens.

6 Claims, 36 Drawing Sheets

Specification includes a Sequence Listing.

ESTEN
In Zika

GEDAP
In Den3

FIG. 12
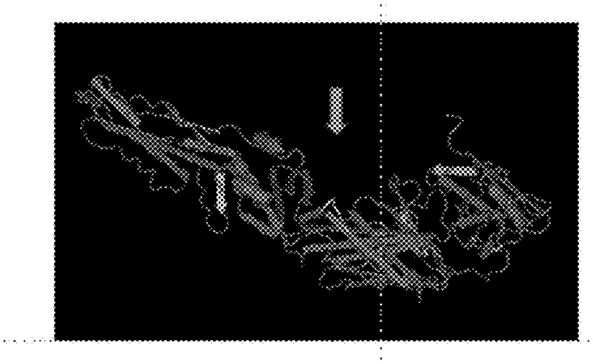
KGRLS Zika
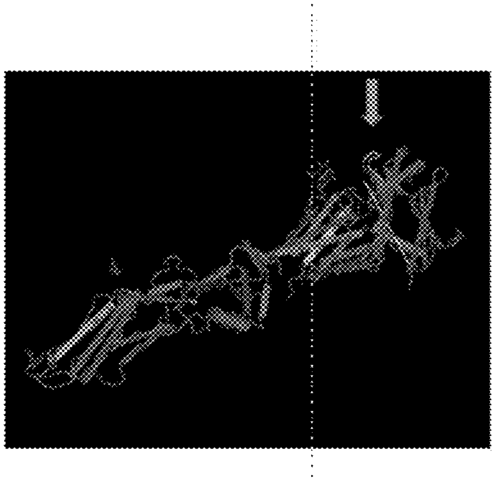
TDKEK Den 1

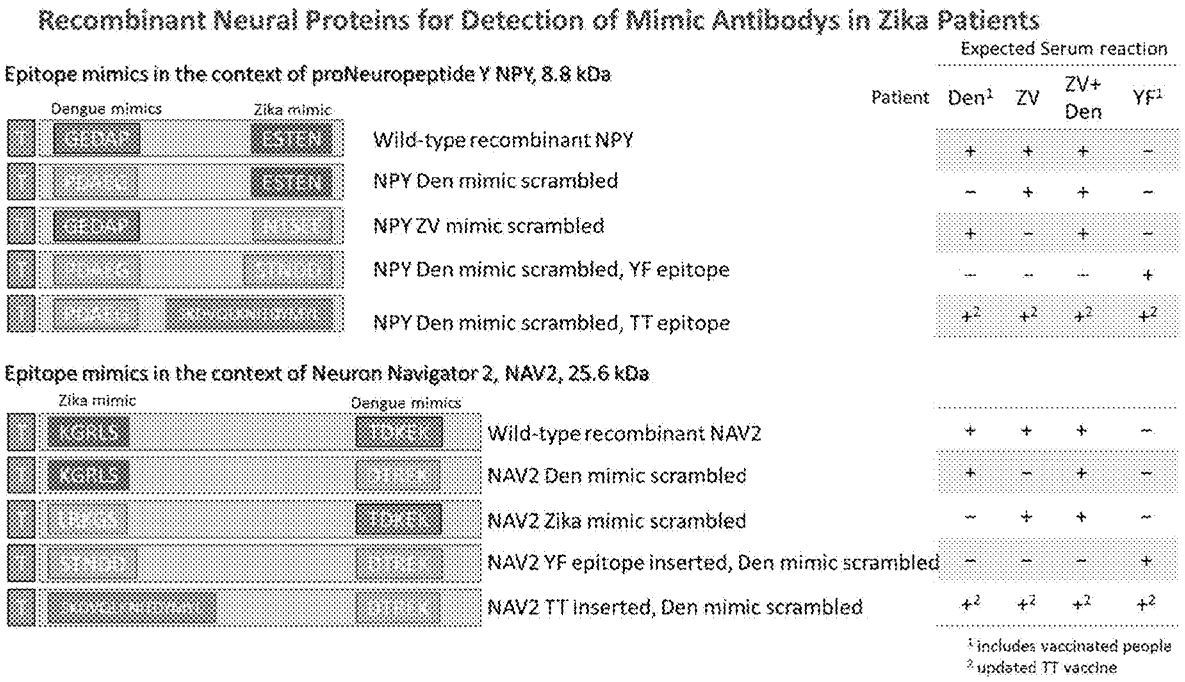

FIG. 16

Recombinant Neural Proteins for Detection of Mimic Antibodys in Zika Patients

Epitope mimics in the context of proNeuropeptide Y NPY, 8.8 kDa

| | | | Expected Serum reaction | | | |
|---|---|---|---|---|---|---|
| Dengue mimics | Zika mimic | Patient | Den[1] | ZV | ZV+Den | YF[1] |
| ▓▓ | ▓▓ | Wild-type recombinant NPY | + | + | + | − |
| ▓▓ | ▓▓ | NPY Den mimic scrambled | − | + | + | − |
| ▓▓ | ▓▓ | NPY ZV mimic scrambled | + | − | + | − |
| ▓▓ | ▓▓ | NPY Den mimic scrambled, YF epitope | − | − | − | + |
| ▓▓ | ▓▓ | NPY Den mimic scrambled, TT epitope | +[2] | +[2] | +[2] | +[2] |

Epitope mimics in the context of Neuron Navigator 2, NAV2, 25.6 kDa

| Zika mimic | Dengue mimics | | | | | |
|---|---|---|---|---|---|---|
| ▓▓ | ▓▓ | Wild-type recombinant NAV2 | + | + | + | − |
| ▓▓ | ▓▓ | NAV2 Den mimic scrambled | + | − | + | − |
| ▓▓ | ▓▓ | NAV2 Zika mimic scrambled | − | + | + | − |
| ▓▓ | ▓▓ | NAV2 YF epitope inserted, Den mimic scrambled | − | − | − | + |
| ▓▓ | ▓▓ | NAV2 TT inserted, Den mimic scrambled | +[2] | +[2] | +[2] | +[2] |

[1] includes vaccinated people
[2] updated TT vaccine

FIG. 22

Cell Plot

| Column | Pep# | BEPI | pos | Flanks | BEPIpent |
|---|---|---|---|---|---|
| DEN1 | 1 | -1.04 | 51 | ELLKTEVTNPAVLRK | EVTNP |
| DEN1 | 2 | -1.84 | 168 | IATITPQAPTSEIQL | PQAPT |
| DEN1 | 3 | -2.09 | 227 | WTSGASTSQETWNRQ | STSQE |
| DEN1 | 4 | -1.57 | 272 | TGATEIQTSGTTTIF | IQTSG |
| DEN1 | 5 | -1.55 | 329 | VQVKYEGTDAPCKIP | EGTDA |
| DEN1 | 6 | -1.77 | 344 | FLTQDEKGVTQNGRL | EKGVT |
| DEN1 | 7 | -0.99 | 361 | ANPIVTDKEKPVNIE | TDKEK |
| DEN1 | 8 | -1.55 | 371 | PVNIETEPPFGESYI | TEPPF |
| DEN2 | 1 | -1.65 | 226 | WLPGADTQGSNWIQK | DTQGS |
| DEN2 | 2 | -1.13 | 228 | PGADTQGSNWIQKET | QGSNW |
| DEN2 | 3 | -1.44 | 244 | VTFKNPHAKKQDVVV | PHAKK |
| DEN2 | 4 | -1.74 | 328 | IRVQYEGDGSPCKIP | EGDGS |
| DEN2 | 5 | -1.27 | 330 | VQYEGDGSPCKIPFE | DGSPC |
| DEN2 | 6 | -1.28 | 362 | PIVTEKDSPVNIEAE | KDSPV |
| DEN2 | 7 | -1.53 | 370 | PVNIEAEPPFGDSYI | AEPPF |
| DEN2 | 8 | -1.14 | 372 | NIEAEPPFGDSYIIV | PPFGD |
| DEN3 | 1 | -1.49 | 154 | QHQVGNETQGVTAEI | NETQG |
| DEN3 | 2 | -2.03 | 224 | WTSGATTETPTWNRK | TTETP |
| DEN3 | 3 | -1.63 | 269 | TGATEIQNSGGTSIF | IQNSG |
| DEN3 | 4 | -1.83 | 311 | VLKKEVSETQHGTIL | VSETQ |
| DEN3 | 5 | -1.24 | 327 | KVEYKGEDAPCKIPF | GEDAP |
| DEN3 | 6 | -1.02 | 327 | KVEYKGEDVPCKIPF | GEDVP |
| DEN3 | 7 | -1.31 | 336 | PCKIPFSTEDGQGKA | FSTED |
| DEN3 | 8 | -1.17 | 360 | PVVTKKEEPVNIEAE | KEEPV |
| DEN3 | 9 | -1.57 | 369 | VNIEAEPPFGESNIV | EPPFG |
| DEN4 | 1 | -1.18 | 48 | DFELTKTTAKEVALL | KTTAK |
| DEN4 | 2 | -1.68 | 155 | HAVGNDTSNHGVTAT | DTSNH |
| DEN4 | 3 | -1.59 | 166 | VTATITPRSPSVEVE | TPRSP |
| DEN4 | 4 | -1.62 | 272 | GATEVDSGDGNHMFA | DSGDG |
| DEN4 | 5 | -1.29 | 315 | DKEMAETQHGTTVVK | ETQHG |
| DEN4 | 6 | -1.44 | 328 | VKVKYEGAGAPCKVP | EGAGA |
| DEN4 | 7 | -1.06 | 358 | ISSIPLAENTNSVTN | LAENT |
| DEN4 | 8 | -1.05 | 362 | PLAENTNSVTNIELE | TNSVT |
| PAN DEN | 1 | . | 313 | | ETQHG |
| PAN DEN | 2 | . | 369 | | EPPFG |
| PAN DEN | 3 | . | 99 | | DAGWG |
| PAN DEN | 4 | . | 185 | | SPRTG |
| PAN DEN | 5 | . | 404 | | TARGA |
| PAN DEN | 6 | . | 394 | | GSSIG |
| PAN DEN | 7 | . | 74 | | RCPTQ |
| PAN DEN | 8 | . | 370 | | PPFGD |
| YF | 1 | -1.04 | 52 | ETVAIDRPAEVRKVC | DRPAE |
| YF | 2 | -1.25 | 150 | HVGAKQENWNTDIKT | QENWN |
| YF | 3 | -1.22 | 165 | LKFDALSGSQEVEFI | LSGSQ |
| YF | 4 | -1.08 | 218 | DLTLPWQSGSGGVWR | WQSGS |
| YF | 5 | -1.50 | 250 | VLALGNQEGSLKTAL | NQEGS |
| YF | 6 | -1.73 | 267 | AMRVTKDTNDNNLYK | KDTND |
| YF | 7 | -2.21 | 311 | FFVKNPTDTGHGTVV | PTDTG |
| YF | 8 | -1.30 | 358 | VNPIASTNDDEVLIE | STNDD |
| YF | 9 | -1.61 | 356 | VTVNPIASTNDDEVL | IASTN |
| YF | 10 | -1.03 | 369 | VLIEVNPPFGDSYII | NPPFG |
| WNV | 1 | -1.52 | 38 | TIMSKDKPTIDVKMM | DKPTI |
| WNV | 2 | -1.11 | 148 | FVHGPTTVESHGKIG | TTVES |
| WNV | 3 | -1.21 | 188 | VTVDCEPRSGIDTSA | EPRSG |
| WNV | 4 | -1.07 | 253 | SVVALGSQEGALHQA | GSQEG |
| WNV | 5 | -0.81 | 295 | EKLQLKGTTYGVCSK | KGTTY |
| WNV | 6 | -1.86 | 312 | KFARTPADTGHGTVV | PADTG |
| WNV | 7 | -1.50 | 327 | LELQYTGTDGPCKVP | TGTDG |
| WNV | 8 | -0.90 | 385 | YIVVGRGEQQINHHW | RGEQQ |
| ZIKV | 1 | -0.82 | 16 | DFVEGMSGGTWVDIV | MSGGT |
| ZIKV | 2 | -1.21 | 38 | TVMAQDKPTVDIELV | DKPTV |
| ZIKV | 3 | -1.41 | 86 | AYLDKQSDTQYVCKR | QSDTQ |
| ZIKV | 4 | -1.37 | 128 | SKKMTGKSIQPENLE | GKSIQ |
| ZIKV | 5 | -0.84 | 145 | IMLSVHGSQHSGMIV | HGSQH |
| ZIKV | 6 | -2.20 | 159 | VNDTGHETDENRAKV | HETDE |
| ZIKV | 7 | -2.01 | 172 | KVEITPNSPRAEATL | PNSPR |
| ZIKV | 8 | -1.70 | 175 | ITPNSPRAEATLGGF | PRAEA |
| ZIKV | 9 | -1.55 | 233 | AGADTGTPHWNNKEA | GTPHW |
| ZIKV | 10 | -1.47 | 282 | EMDGAKGRLSSGHLK | KGRLS |
| ZIKV | 11 | -1.56 | 335 | EVQYAGTDGPCKVPA | GTDGP |
| ZIKV | 12 | -1.14 | 365 | ITANPVITESTENSK | VITES |
| ZIKV | 13 | -1.51 | 368 | NPVITESTENSKMML | ESTEN |
| ZIKV | 14 | -1.05 | 370 | VITESTENSKMMLEL | TENSK |
| CHIK | 1 | -1.14 | 40 | ALERIRNEATDGTLK | RNEAT |
| CHIK | 2 | -1.21 | 144 | GREKFHSRPQHGKEL | HSRPQ |
| CHIK | 3 | -1.18 | 249 | VPRNAELGDRKGKIH | EFGDR |
| CHIK | 4 | -1.46 | 274 | RVPKARNPTVTYGKN | RNPTV |
| CHIK | 5 | -1.14 | 276 | PKARNPTVTYGKNQV | PTVTY |
| CHIK | 6 | -1.27 | 303 | SYRNMGEEPNYQEEW | GEEPN |
| CHIK | 7 | -0.70 | 334 | EVTWGNNEPYKYWPQ | NNEPY |
| CHIK | 8 | -1.33 | 347 | PQLSTNGTAHGHPHE | NGTAH |

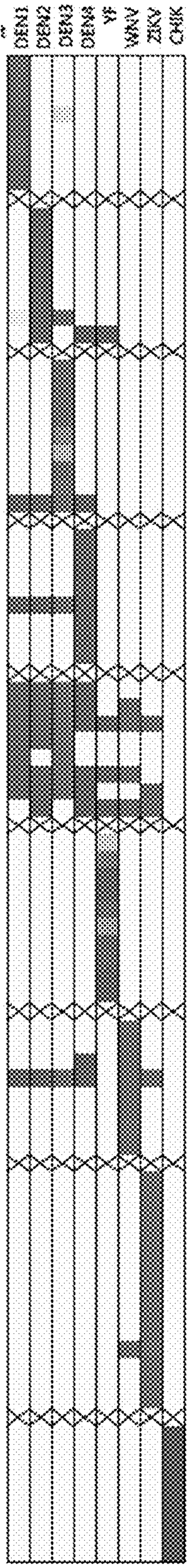

FIG. 23

Cell Plot

| Column | Pep# | BEPI | pos | BepiPent | Flanks |
|---|---|---|---|---|---|
| DEN1 | 1 | -1.45 | 38 | DSPKR | YKFQADSPKRLSAAI |
| DEN1 | 2 | -0.75 | 104 | MIRPQ | AQGKKMIRPQPMEHK |
| DEN1 | 3 | -1.84 | 141 | TPECP | IDGPDTPECPDGQRA |
| DEN1 | 4 | -1.27 | 144 | CPDGQ | PDTPECPDGQRAWNI |
| DEN1 | 5 | -0.94 | 190 | KDSKA | MSAAIKDSKAVHADM |
| DEN1 | 6 | -1.17 | 206 | EKNET | YWIESEKNETWKLAR |
| DEN1 | 7 | -1.46 | 294 | NRGPS | DEHCGNRGPSLRTTT |
| DEN1 | 8 | -0.81 | 301 | TTTVT | GPSLRTTTVTGKIIH |
| DEN2 | 1 | -1.50 | 39 | SPSKL | KFQPESPSKLASAIQ |
| DEN2 | 2 | -2.00 | 105 | LRPQP | AGKRSLRPQPTELKY |
| DEN2 | 3 | -1.15 | 126 | STESH | KAKMLSTESHNQTFL |
| DEN2 | 4 | -1.43 | 142 | AECPN | DGPETAECPNTNRAW |
| DEN2 | 5 | -0.83 | 191 | DNRAV | SAAIKDNRAVHADMG |
| DEN2 | 6 | -1.03 | 248 | FAGPV | IIPKNFAGPVSQHNY |
| DEN2 | 7 | -1.02 | 262 | HTQTA | YRPGYHTQTAGPWHL |
| DEN2 | 8 | -1.37 | 291 | DCGNR | VVVTEDCGNRGPSLR |
| DEN3 | 1 | -1.40 | 37 | ADSPK | QYKFQADSPKRLATA |
| DEN3 | 2 | -1.33 | 103 | RTLTP | LKQGKRTLTPQPMEL |
| DEN3 | 3 | -1.80 | 140 | NTPEC | IIDGPNTPECPSASR |
| DEN3 | 4 | -0.90 | 190 | KDERA | MSAAVKDERAVHADM |
| DEN3 | 5 | -1.32 | 207 | KNGSW | WIESQKNGSWKLEKA |
| DEN3 | 6 | -1.11 | 257 | HRPGY | ISQHNHRPGYHTQTA |
| DEN3 | 7 | -0.86 | 290 | ENCGT | TVVITENCGTRGPSL |
| DEN3 | 8 | -0.86 | 301 | TTTVS | GPSLRTTTVSGKLIH |
| DEN4 | 1 | -1.18 | 39 | SPARL | KFQPESPARLASAIL |
| DEN4 | 2 | -1.63 | 104 | ALTPP | TKGKRALTPPVSDLK |
| DEN4 | 3 | -1.07 | 125 | FTPEA | GKAKIFTPEARNSTF |
| DEN4 | 4 | -1.81 | 140 | DTSEC | LIDGPDTSECPNERR |
| DEN4 | 5 | -1.25 | 207 | KNQTW | WIESSKNQTWQIEKA |
| DEN4 | 6 | -1.20 | 248 | YAGPF | LIPKSYAGPFSQHNY |
| DEN4 | 7 | -1.01 | 260 | GYATQ | HNYRQGYATQTVGPW |
| DEN4 | 8 | -1.19 | 292 | CDHRG | TIQEDCDHRGPSLRT |
| WNV | 1 | -1.69 | 38 | PETPQ | RYKYYPETPQGLAKI |
| WNV | 2 | -1.16 | 102 | APKRL | GMYKSAPKRLTATTE |
| WNV | 3 | -1.43 | 144 | ECPTQ | GPETKECPTQNRAWN |
| WNV | 4 | -1.74 | 177 | NTTEC | KVRESNTTECDSKII |
| WNV | 5 | -1.47 | 261 | GYKTQ | HNRRPGYKTQNQGPW |
| WNV | 6 | -1.90 | 266 | NQGPW | GYKTQNQGPWDEGRV |
| WNV | 7 | -1.67 | 297 | GPATR | SCGHRGPATRTTTES |
| WNV | 8 | -1.54 | 303 | TTESG | PATRTTTESGKLITD |
| YF | 1 | -1.21 | 35 | YYPED | LNKYSYYPEDPVKLA |
| YF | 2 | -1.41 | 140 | SRKEC | IIDGKSRKECPFSNR |
| YF | 3 | -2.21 | 193 | KSAHG | AVNGKKSAHGSPTFW |
| YF | 4 | -1.12 | 234 | GTSVE | LTHTIGTSVEESEMF |
| YF | 5 | -1.05 | 264 | QTNGP | PGYKVQTNGPWMQVP |
| YF | 6 | -2.05 | 295 | RGKST | GNCDGRGKSTRSTTD |
| YF | 7 | -2.15 | 301 | STTDS | GKSTRSTTDSGKVIP |
| YF | 8 | -1.15 | 338 | PRKTH | PMEIRPRKTHESHLV |
| ZIKV | 1 | -1.55 | 14 | KETRC | VDFSKKETRCGTGVF |
| ZIKV | 2 | -1.62 | 38 | HPDSP | DRYKYHPDSPRRLAA |
| ZIKV | 3 | -1.06 | 130 | AKTNN | HFVRAAKTNNSFVVD |
| ZIKV | 4 | -1.23 | 193 | GKEAV | GTAVKGKEAVHSDLG |
| ZIKV | 5 | -1.23 | 209 | KNDTW | WIESEKNDTWRLKRA |
| ZIKV | 6 | -1.36 | 259 | TREGY | LSHHNTREGYRTQMK |
| ZIKV | 7 | -0.86 | 291 | EETCG | TKVHVEETCGTRGPS |
| ZIKV | 8 | -1.56 | 303 | STTAS | GPSLRSTTASGRVIE |
| ZIKV | 9 | -1.85 | 341 | RKEPE | MEIRPRKEPESNLVR |

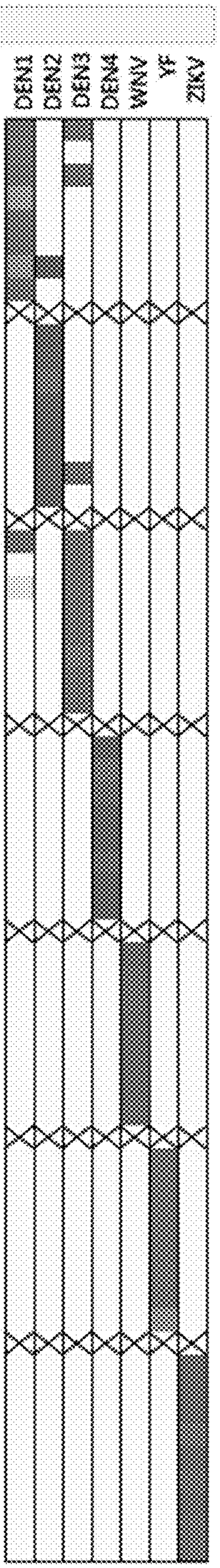

FIG. 24

Cell Plot

| Column | BEPI | pos | Flanks | BEPIpent |
|---|---|---|---|---|
| Isolates | | | | |
| proteins | | | | |
| DEN1 | -1.04 | 51 | ELLKTEVTNPAVLRK | EVTNP |
| DEN1 | -1.84 | 168 | IATITPQAPTSEIQL | PQAPT |
| DEN1 | -2.09 | 227 | WTSGASTSQETWNRQ | STSQE |
| DEN1 | -1.57 | 272 | TGATEIQTSGTTTIF | IQTSG |
| DEN1 | -1.55 | 329 | VQVKYEGTDAPCKIP | EGTDA |
| DEN1 | -1.77 | 348 | FLTQDEKGVTQNGRL | EKGVT |
| DEN1 | -0.99 | 361 | ANPIVTDKEKPVNIE | TDKEK |
| DEN1 | -1.55 | 371 | PVNIETEPPFGESYI | TEPPF |
| DEN2 | -1.65 | 226 | WLPGADTQGSNWIQK | DTQGS |
| DEN2 | -1.13 | 228 | PGADTQGSNWIQKET | QGSNW |
| DEN2 | -1.44 | 244 | VTFKNPHAKKQDVVV | PHAKK |
| DEN2 | -1.74 | 328 | IRVQYEGDGSPCKIP | EGDGS |
| DEN2 | -1.27 | 330 | VQYEGDGSPCKIPFE | DGSPC |
| DEN2 | -1.28 | 362 | PIVTEKDSPVNIEAE | KDSPV |
| DEN2 | -1.53 | 370 | PVNIEAEPPFGDSYI | AEPPF |
| DEN2 | -1.14 | 372 | NIEAEPPFGDSYIIV | PPFGD |
| DEN3 | -1.49 | 154 | QHQVGNETQGVTAEI | NETQG |
| DEN3 | -2.03 | 224 | WTSGATTETPTWNRK | TTETP |
| DEN3 | -1.63 | 269 | TGATEIQNSGGTSIF | IQNSG |
| DEN3 | -1.63 | 311 | VLKKEVSETQHGTIL | VSETQ |
| DEN3 | -1.24 | 327 | KVEYKGEDAPCKIPF | GEDAP |
| DEN3 | -1.02 | 327 | KVEYKGEDVPCKIPF | GEDVP |
| DEN3 | -1.31 | 336 | PCKIPFSTEDGQGKA | FSTED |
| DEN3 | -1.17 | 360 | PVVTKKEEPVNIEAE | KEEPV |
| DEN3 | -1.57 | 369 | VNIEAEPPFGESNIV | EPPFG |
| DEN4 | -1.18 | 48 | DFELTKTTAKEVALL | KTTAK |
| DEN4 | -1.68 | 155 | HAVGNDTSNHGVTAT | DTSNH |
| DEN4 | -1.39 | 166 | VTATITPRSPSVEVE | TPRSP |
| DEN4 | -1.62 | 272 | GATEVDSGDGNHMFA | DSGDG |
| DEN4 | -1.29 | 315 | DKEMAETQHGTTVVK | ETQHG |
| DEN4 | -1.44 | 328 | VKVKYEGAGAPCKVP | EGAGA |
| DEN4 | -1.06 | 358 | ISSIPLAENTNSVTN | LAENT |
| DEN4 | -1.05 | 362 | PLAENTNSVTNIELE | TNSVT |
| PAN DEN | | 313 | | ETQHG |
| PAN DEN | | 389 | | EPPFG |
| PAN DEN | | 99 | | DRGWG |
| PAN DEN | | 185 | | SPRTG |
| PAN DEN | | 404 | | TARGA |
| PAN DEN | | 394 | | GSSIG |
| PAN DEN | | 74 | | RCPTQ |
| PAN DEN | | 370 | | PPFGD |
| YF | -1.04 | 52 | ETVAIDRPAEVRKVC | DRPAE |
| YF | -1.25 | 150 | HVGAKQENWNTDIKT | QENWN |
| YF | -1.22 | 165 | LKFDALSGSQEVEFI | LSGSQ |
| YF | -1.08 | 218 | DLTLPWQSGSGGVWR | WQSGS |
| YF | -1.50 | 250 | VLALGNQEGSLKTAL | NQEGS |
| YF | -1.73 | 267 | AMRVTKDTNDNNLYK | KDTND |
| YF | -2.21 | 311 | FPVKNPTDTGHGTVV | PTDTG |
| YF | -1.30 | 358 | VNPIASTNDDEVLIE | STNDD |
| YF | -1.61 | 356 | VTVNPIASTNDDEVL | IASTN |
| YF | -1.03 | 369 | VLIEVNPPFGDSYII | NPPFG |
| WNV | -1.52 | 38 | TDMSKDKPTIDVKMM | DKPTI |
| WNV | -1.11 | 148 | FVHGPTTVESHGKIG | TTVES |
| WNV | -1.21 | 188 | VTVDCEPRSGIDTSA | EPRSG |
| WNV | -1.07 | 253 | SVVALGSQEGALHQA | GSQEG |
| WNV | -0.81 | 295 | EKLQLKGTTYGVCSK | KGTTY |
| WNV | -1.86 | 312 | KFARTPADTGHGTVV | PADTG |
| WNV | -1.50 | 327 | LELQYTGTDGPCKVP | TGTDG |
| WNV | -0.90 | 385 | YIVVGRGEQQINHHW | RGEQQ |
| ZIKV | -0.62 | 18 | DFVEGMSGGTWVDIV | MSGGT |
| ZIKV | -1.21 | 38 | TVMAQDKPTVDIELV | DKPTV |
| ZIKV | -1.41 | 86 | AYLDKQSDTQYVCKR | QSDTQ |
| ZIKV | -1.37 | 128 | SKKMTGKSIQPENLE | GKSIQ |
| ZIKV | -0.84 | 145 | IMLSVHGSQHSGMIV | HGSQH |
| ZIKV | -2.20 | 159 | VNDTGHETDENRAKV | HETDE |
| ZIKV | -2.01 | 172 | KVEITPNSPRAEATL | PNSPR |
| ZIKV | -1.70 | 175 | ITPNSPRAEATLGGF | PRAEA |
| ZIKV | -1.55 | 233 | AGADTGTPHWNNKEA | GTPHW |
| ZIKV | -1.47 | 282 | EMDGAKGRLSSGHLK | KGRLS |
| ZIKV | -1.56 | 335 | EVQYAGTDGPCKVPA | GTDGP |
| ZIKV | -1.34 | 365 | ITANPVITESTENSK | VITES |
| ZIKV | -1.51 | 368 | NPVITESTENSKMML | ESTEN |
| ZIKV | -1.05 | 370 | VITESTENSKMMLEL | TENSK |
| CHIK | -1.14 | 40 | ALERIRNEATDGTLK | RNEAT |
| CHIK | -1.21 | 144 | GREKFHSRPQHGKEL | HSRPQ |
| CHIK | -1.18 | 249 | VPIRNAELGDRKGKIH | EFGDR |
| CHIK | -1.46 | 274 | RVPKARNPTVTYGKN | RNPTV |
| CHIK | -1.14 | 276 | PKARNPTVTYGKNQV | PTVTY |
| CHIK | -1.27 | 303 | SYRNMGEEPNYQEEW | GEEPN |
| CHIK | -0.70 | 334 | EVTWGNNEPYKYWPQ | NNEPY |
| CHIK | -1.33 | 347 | PQLSTNGTAHGHPHE | NGTAH |

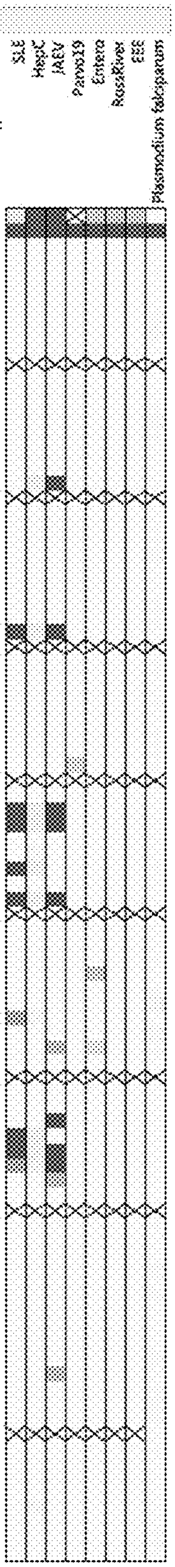

FIG. 25

Cell Plot

| Column | Pep# | BEPI | pos | BepiPent | Flanks |
|---|---|---|---|---|---|
| DEN1 | 1 | -1.45 | 38 | DSPKR | YKFQADSPKRLSAAI |
| DEN1 | 2 | -0.75 | 104 | MIRPQ | AQGKKMIRPQPMEHK |
| DEN1 | 3 | -1.84 | 141 | TPECP | IDGPDTPECPDGQRA |
| DEN1 | 4 | -1.27 | 144 | CPDGQ | PDTPECPDGQRAWNI |
| DEN1 | 5 | -0.94 | 190 | KDSKA | MSAAIKDSKAVHADM |
| DEN1 | 6 | -1.17 | 206 | EKNET | YWIESEKNETWKLAR |
| DEN1 | 7 | -1.46 | 294 | NRGPS | DEHCGNRGPSLRTTT |
| DEN1 | 8 | -0.81 | 301 | TTTVT | GPSLRTTTVTGKIIH |
| DEN2 | 1 | -1.50 | 39 | SPSKL | KFQPESPSKLASAIQ |
| DEN2 | 2 | -2.00 | 105 | LRPQP | AGKRSLRPQPTELKY |
| DEN2 | 3 | -1.15 | 126 | STESH | KAKMLSTESHNQTFL |
| DEN2 | 4 | -1.43 | 142 | AECPN | DGPETAECPNTNRAW |
| DEN2 | 5 | -0.83 | 191 | DNRAV | SAAIKDNRAVHADMG |
| DEN2 | 6 | -1.03 | 248 | FAGPV | IIPKNFAGPVSQHNY |
| DEN2 | 7 | -1.02 | 262 | HTQTA | YRPGYHTQTAGPWHL |
| DEN2 | 8 | -1.37 | 291 | DCGNR | VVVTEDCGNRGPSLR |
| DEN3 | 1 | -1.40 | 37 | ADSPK | QYKFQADSPKRLATA |
| DEN3 | 2 | -1.33 | 103 | RTLTP | LKQGKRTLTPQPMEL |
| DEN3 | 3 | -1.80 | 140 | NTPEC | IIDGPNTPECPSASR |
| DEN3 | 4 | -0.90 | 190 | KDERA | MSAAVKDERAVHADM |
| DEN3 | 5 | -1.32 | 207 | KNGSW | WIESQKNGSWKLEKA |
| DEN3 | 6 | -1.11 | 257 | HRPGY | ISQHNHRPGYHTQTA |
| DEN3 | 7 | -0.86 | 290 | ENCGT | TVVITENCGTRGPSL |
| DEN3 | 8 | -0.86 | 301 | TTTVS | GPSLRTTTVSGKLIH |
| DEN4 | 1 | -1.18 | 39 | SPARL | KFQPESPARLASAIL |
| DEN4 | 2 | -1.63 | 104 | ALTPP | TKGKRALTPPVSDLK |
| DEN4 | 3 | -1.07 | 125 | FTPEA | GKAKIFTPEARNSTF |
| DEN4 | 4 | -1.81 | 140 | DTSEC | LIDGPDTSECPNERR |
| DEN4 | 5 | -1.25 | 207 | KNQTW | WIESSKNQTWQIEKA |
| DEN4 | 6 | -1.20 | 248 | YAGPF | LIPKSYAGPFSQHNY |
| DEN4 | 7 | -1.01 | 260 | GYATQ | HNYRQGYATQTVGPW |
| DEN4 | 8 | -1.19 | 292 | CDHRG | TIQEDCDHRGPSLRT |
| WNV | 1 | -1.69 | 38 | PETPQ | RYKYYPETPQGLAKI |
| WNV | 2 | -1.16 | 102 | APKRL | GMYKSAPKRLTATTE |
| WNV | 3 | -1.43 | 144 | ECPTQ | GPETKECPTQNRAWN |
| WNV | 4 | -1.74 | 177 | NTTEC | KVRESNTTECDSKII |
| WNV | 5 | -1.47 | 261 | GYKTQ | HNRRPGYKTQNQGPW |
| WNV | 6 | -1.90 | 266 | NQGPW | GYKTQNQGPWDEGRV |
| WNV | 7 | -1.67 | 297 | GPATR | SCGHRGPATRTTTES |
| WNV | 8 | -1.54 | 303 | TTESG | PATRTTTESGKLITD |
| YF | 1 | -1.21 | 35 | YYPED | LNKYSYYPEDPVKLA |
| YF | 2 | -1.41 | 140 | SRKEC | IIDGKSRKECPFSNR |
| YF | 3 | -2.21 | 193 | KSAHG | AVNGKKSAHGSPTFW |
| YF | 4 | -1.12 | 234 | GTSVE | LTHTIGTSVEESEMF |
| YF | 5 | -1.05 | 264 | QTNGP | PGYKVQTNGPWMQVP |
| YF | 6 | -2.05 | 295 | RGKST | GNCDGRGKSTRSTTD |
| YF | 7 | -2.15 | 301 | STTDS | GKSTRSTTDSGKVIP |
| YF | 8 | -1.15 | 338 | PRKTH | PMEIRPRKTHESHLV |
| ZIKV | 1 | -1.55 | 14 | KETRC | VDFSKKETRCGTGVF |
| ZIKV | 2 | -1.62 | 38 | HPDSP | DRYKYHPDSPRRLAA |
| ZIKV | 3 | -1.06 | 130 | AKTNN | HFVRAAKTNNSFVVD |
| ZIKV | 4 | -1.23 | 193 | GKEAV | GTAVKGKEAVHSDLG |
| ZIKV | 5 | -1.23 | 209 | KNDTW | WIESEKNDTWRLKRA |
| ZIKV | 6 | -1.36 | 259 | TREGY | LSHHNTREGYRTQMK |
| ZIKV | 7 | -0.86 | 291 | EETCG | TKVHVEETCGTRGPS |
| ZIKV | 8 | -1.56 | 303 | STTAS | GPSLRSTTASGRVIE |
| ZIKV | 9 | -1.65 | 341 | RKEPE | MEIRPRKEPESNLVR |

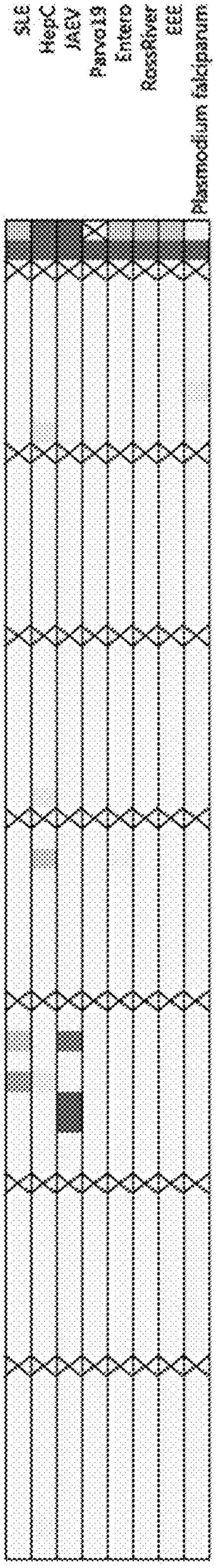

FIG. 26

| | | BEPI (virus) | P_falciparum BEPI (standard uTOPE) | gi : curation | P_vivax BEPI (standard uTOPE) | gi : curation (P_vivax) | Virus |
|---|---|---|---|---|---|---|---|
| 93 | CKRTL | 0.55 | | | | | Zika |
| 94 | KRTLV | 0.36 | | | 0.24 | PVX_092435 product_signal recognition particle subunit SRP72 | Zika |
| 95 | KTLVD | 0.18 | 0.85 | PF3D7_1149000 product_antigen 332 | | | Zika |
| 96 | TLVDR | -0.03 | 0.60 | PF3D7_1013600 product_conserved Plasmodium protein | 0.34 | PVX_118490 product_hypothetical protein | Zika |
| 97 | LVDRG | -0.25 | | | -0.06 | PVX_111120 product_asparagine-rich antigen | Zika |
| 98 | VDRGW | -0.40 | | | | | Zika |
| | DRGWG | -0.50 | | | | | Zika |
| | RGWGN | -0.45 | | | | | Zika |
| 101 | GWGNG | -0.35 | | | | | Zika |
| 102 | WGNGC | -0.21 | | | | | Zika |
| 103 | GNGCG | -0.07 | | | 1.32 | PVX_003475 product_hypothetical protein | Zika |
| 104 | NGCGL | 0.02 | | | 0.93 | PVX_081260 product_transcription initiation factor TFIIB | Zika |
| 105 | GCGLF | 0.03 | | | | | Zika |
| 106 | CGLFG | 0.02 | 1.04 | PF3D7_1333200 product_ubiquitin-activating enzyme (UBA1) | 0.17 | PVX_113460 product_DNA repair protein RAD50 | Zika |

| | BEPIpenta | BEPI (virus) | P_falciparum BEPI (standard uTOPE) | gi : curation | P_vivax BEPI (standard uTOPE) | gi : curation (P_vivax) | Virus |
|---|---|---|---|---|---|---|---|
| 91 | YVCKH | 0.48 | | | 1.19 | PVX_117595 product_hypothetical protein | [illegible] |
| 92 | VCKHT | 0.56 | | | 0.90 | PVX_117595 product_hypothetical protein | [illegible] |
| 93 | CKHTY | 0.51 | 0.39 | PF3D7_1436100 product_conserved Plasmodium memb... | | | [illegible] |
| 94 | KHTYV | 0.31 | 0.00 | PF3D7_1107200 product_conserved Plasmodium protein | 0.19 | PVX_091035 product_hypothetical protein | [illegible] |
| 95 | HTYVD | 0.11 | | PF3D7_1009800 product_conserved Plasmodium memb... | | | [illegible] |
| 96 | TYVDR | -0.09 | | | | | [illegible] |
| 97 | YVDRG | -0.29 | -0.22 | PF3D7_0802800 product_serine_threonine protein phos... | -0.38 | PVX_085730 product_serine_threonine protein phospha... | [illegible] |
| 98 | VDRGW | -0.45 | | | | | [illegible] |
| | **DRGWG** | **-0.48** | | | | | DEN3 |
| | **RGWGN** | **-0.45** | | | | | DEN3 |
| 101 | GWGNG | -0.37 | | | | | [illegible] |
| 102 | WGNGC | -0.23 | | | | | [illegible] |
| 103 | GNGCG | -0.08 | | | 1.32 | PVX_003475 product_hypothetical protein | [illegible] |
| 104 | NGCGL | 0.00 | | | 0.93 | PVX_081260 product_transcription initiation factor TFIIB | [illegible] |
| 105 | GCGLF | -0.00 | | | | | [illegible] |

MODIFIED ZIKA VIRUS NS1 PROTEIN WITH REDUCED CROSS-REACTIVE IMMUNOGENICITY

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 696,000 Byte ASCII (Text) file named "34749-259_ST25," created on Jun. 18, 2020.

FIELD OF THE INVENTION

The present invention relates to vaccine compositions and therapeutic interventions for treating and preventing infections and diseases caused by flaviviruses, including Zika, dengue, and Usutu virus. It also relates to compositions and methods for diagnosis and differential diagnosis of flaviviruses and co-endemic pathogens.

BACKGROUND OF THE INVENTION

The flaviviruses comprise a large family of arthropod borne viruses which cause a diverse array of clinical diseases. Included in the flavivirus family are dengue, yellow fever, Zika virus, West Nile virus, St Louis encephalitis virus, Japanese encephalitis virus, Murray Valley virus, Usutu virus, and Tick borne encephalitis virus. A number of other flaviviruses are, and continue to be, recognized as emerging pathogens, so this list is not considered limiting. Clinical signs differ widely between flavivirus infections, from cardiovascular and hemorrhagic signs, to jaundice, neurologic and teratogenic manifestations. The molecular structure of the flavivirus family is highly conserved with minor sequence differences leading to the diverse clinical signs. Thus, while the present invention focuses on dengue, Zika virus, and Usutu virus, it will be apparent to those skilled in the art that the approaches used are not restricted to these viruses and that the examples and embodiments are likewise not limited to these viruses.

Zika virus (ZIKV) is a rapidly emerging epidemic arboviral disease which has infected over a million people in Brazil [1]. Zika virus has now spread throughout the Americas and to many other countries. While generally an inapparent or mild febrile disease, Zika virus infections have led to thousands of cases of microencephaly in children born to mothers pregnant at the time of infection. There is a growing awareness also of a high rate of Guillian Barré syndrome (GBS) and other neurologic complications following infection, as well as complications leading to thrombocytopenia. Co-endemnicity with dengue may contribute to the disease manifestations and also complicates differential diagnosis. In addition, epitope mimics in both viruses may result in a compounded clinical effect.

Dengue is a major and rapidly expanding public health challenge in tropical and subtropical areas, responsible for hundreds of millions of infections and approaching 100 million clinical cases worldwide each year [2]. Caused by 4 closely related serotypes of flavivirus, it is a second infection with a different serotype which leads to the most severe cases of dengue, dengue hemorrhagic fever. Severe dengue and dengue hemorrhagic fever (DHF) is characterized by spontaneous hemorrhage, increased vascular permeability, hematuria and thrombocytopenia. The severity of second infections has been attributed to the phenomenon of antibody dependent enhancement (ADE), in which prior non-neutralizing, or sub neutralizing, antibody facilitates uptake of virus and enhances virus titer [3]. The primary epitope to which ADE has been attributed is conserved across all dengue envelope proteins and is in the domain II of envelope protein, in the region known as the fusion loop [4]. While ADE undoubtedly contributes to the severity of dengue, it may not be the only factor. Recent studies of NS1, a non-structural protein which is shed into the extracellular space in large amounts in dengue, show that NS1 levels are a predictor of dengue severity [5] and that this may relate to the role of NS1 in focusing virus assembly [6, 7]. A puzzling aspect remains which is that the severity of DHF peaks days after NS1 levels have diminished [8], indicating that other NS1 related factors may be in play.

Usutu virus (USUV) is another emerging flavivirus, first identified in South Africa in 1959, but recently associated with clinical cases in southern Europe [9], and now considered a threat to Latin America [10]. While not associated with major disease outbreaks in endemic areas, Usutu virus has been linked to fever, rash, and meningoencephalitis [9].

There is a compelling and urgent need for development of preventive and therapeutic interventions and diagnostics for the emerging flaviviruses. The present invention builds on immunoinformatic analyses which have identified mechanisms of autoimmune pathogenesis, and which identify key epitopes and, hence, provide compositions and methods for design of countermeasures and diagnostics for dengue, Zika, and Usutu virus.

The present invention also builds on immunoinformatic analysis which has identified epitope commonalities between Zika and its related flaviviruses and *Plasmodium falciparum* and *Plasmodium vivax*. The invention provides compositions and methods based on identification of *Plasmodium* epitopes which cross react with Zika and related flaviviruses.

SUMMARY OF THE INVENTION

The present invention relates to vaccine compositions and therapeutic interventions for treating and preventing flavivirus infection and disease. It further relates to diagnostics for flavivirus infection. In particular, the present invention pertains to the design of interventions for flaviviruses based on understanding of epitope mimics within the virus structural and non-structural proteins which may contribute to pathogenesis through autoimmune mechanisms. The present invention addresses particularly compositions and methods for the above pertaining to Zika virus, dengue viruses, and Usutu virus. The present invention addresses the cross reactions between flaviviruses and malaria and provides vaccine compositions and differential diagnostics based on the identification of cross reacting epitopes.

Vaccines

In one embodiment the present invention uses immunoinformatic modelling to characterize the distribution of epitopes in the structural proteins of flaviviruses, including Zika virus, and to differentiate those among Zika virus strains, as well as between Zika virus and other co-endemic flaviviruses such as dengue and yellow fever, and to differentiate Zika virus from West Nile virus and Usutu virus.

In particular embodiments of the invention, the synthetic sub polypeptides of the virus proteins are from the envelope protein or NS1 protein of Zika virus and other flaviruses and have been engineered to remove or to mutate peptides which are identified as epitope mimics for human proteins. Such epitope mimics may cause the antibodies elicited in response to viral infection to bind to, and compromise the function of, identical B cell epitopes on the human protein. In other instances such epitope mimics may compete for binding with other ligands which would otherwise bind the corresponding peptides in human proteins.

In some cases, the human proteins are proteins which affect neurologic function and development. In particular cases the epitope mimics occur in human neuropeptide Y. In yet other embodiments, the mimic is in another neural protein, including but not limited to neurotrophin 4, neural cell adhesion molecule, neuron navigator, neurogenic differentiation factor, glial fibrillary acidic protein, glycoprotein M6A and others. In yet further embodiments, the epitope mimics occur in other neural proteins including but not limited to optineurin and brain derived neurotrophic factor, cochlin, synaptogyrin, and SNP29.

In one preferred embodiment a mimic epitope in NS1 is removed by mutation or by replacement with a scrambled motif. The mimic epitope is one which mimics an amino acid motif on a protein associated with microcephaly. In a particular embodiment the mimic motif is one that is found in abnormal spindle-like microcephaly associated protein (ASPM).

In one embodiment, the present invention uses immunoinformatic modelling to characterize the distribution of epitopes in the NS1 proteins of flaviruses and to differentiate those between dengue, Zika virus and other flaviviruses including, but not limited to, yellow fever, West Nile virus, Usutu, Tickborne encephalitis, and Japanese encephalitis virus.

Some embodiments of the present invention also identify epitope mimics which arise in dengue virus, Zika virus, and Usutu virus which match epitopes in the human protein in proteins which function in the cardiovascular proteins of the human proteome and may contribute to autoimmune responses manifest in clinical signs especially in Zika and in dengue. In one particular embodiment the invention identifies the desirability of removing B cell epitope mimics in the NS1 C terminal loop of dengue, Zika viruses, by mutation, deletion or replacement, to mitigate the likelihood of these epitopes stimulating autoimmune antibodies to proteins with cardiovascular functions, including but not limited to, clotting factors, von Willebrand factor, ADAMTS13, prothrombin and vascular endothelial growth factors and receptors of these. In particular embodiments vaccines for Zika and dengue are described in which such cardiovascular protein mimics are removed; in yet other embodiments host cells and vectors expressing vaccine synthetic polypeptides are described.

Additional epitope mimics are found in PrM protein and NS3 protein for human CDK5Rap2 protein, in NS4B for ASPM and for centromere protein 135; therefore in particular embodiments the removal mutation or deletion of these epitope mimics is provided. Accordingly, the present invention provides synthetic or variant viral polypeptide sequences that have a mutation such as a substitution mutation or deletion mutation in one of the identified sequences. In some embodiments, the mutation is a deletion mutation that removes all or part of the epitope mimic so that the polypeptide does not cross react with antibodies specific for the wild type epitope mimic. In some embodiments, the mutation is a substitution mutation or insertion mutation that alters the epitope mimic so that the polypeptide does not cross react with antibodies specific for the wild type epitope mimic.

An embodiment of the invention is the design of vaccines which can be administered to subjects at risk of infection to prevent primary Zika virus infection or infection with other flaviviruses and to direct antibody responses to preferred epitopes.

In one embodiment, the invention describes the expression of the soluble component of the Zika virus envelope protein in a mammalian cell line as a standalone synthetic polypeptide. In a further embodiment, the soluble component of envelope protein is expressed as a synthetic polypeptide fusion to at least a part of an immunoglobulin molecule. In some embodiments thereof the immunoglobulin molecule is engineered to remove Fc binding regions.

In further embodiments the invention describes the preparation of subviral particles comprising PrM and envelope proteins of Zika virus in which epitope mimics of interest have been mutated. In some embodiments subviral particles are prepared comprising PrM and envelope proteins of Zika virus from which a cross reactive epitope for dengue and other flaviviruses has been mutated to prevent cross reactivity.

In some embodiments the synthetic polypeptides embodied in this invention may be expressed in a mammalian cell line, harvested, and delivered directly to the subject. In yet other embodiments the synthetic polypeptide may be incorporated into a particular delivery vehicle including but not limited to a nanoparticle or virus-like particle. In yet other embodiments a Zika virus synthetic envelope polypeptide, engineered to delete or mutate epitope mimics, may be incorporated as a chimera or pseudotype into a live virus vaccine where other proteins are derived from a heterologous flavivirus. In some particular embodiments the heterologous flavivirus may be a yellow fever vaccine strain. In further embodiments the Zika virus synthetic envelope polypeptide, engineered to delete or mutate epitope mimics is delivered in a viral vector, including but not limited to an adenoviral vector or a poxvirus vector. In yet other embodiments other modes of expression of the virus polypeptide are used which in some embodiments includes expression in a prokaryotic system. In some embodiments, DNA encoding the synthetic polypeptides embodied herein are delivered directly to a patient.

As a supporting embodiment to those described above, this invention also embodies the cell lines which express the proteins, polypeptides, peptides and fusions thereof and the vectors which comprise the genetic constructs of proteins, polypeptides, peptides and fusions thereof.

In some embodiments of the present invention describe the preparation of antibodies for diagnostic or therapeutic use in the management of Zika virus infection. Such antibodies may be prepared by immunization of a laboratory animal with one of the synthetic Zika virus envelope polypeptides prepared as described for vaccines, including but not limited to whole soluble Zika virus envelope protein, and various sub-polypeptides thereof. In some cases, the Zika envelope polypeptide used as an immunogen may be fused to an immunoglobulin or portion thereof. In other particular embodiments the Zika virus polypeptide has been mutated or engineered to delete or abrogate an epitope mimic for a human proteome protein, in particular for human proteins with neurologic function, as described for vaccines. In some instances, the immunoglobulin is prepared by immunization with a short peptide linked to a carrier to ensure an epitope specific antibody. In some embodiments the immunoglobulins prepared by immunization with a synthetic Zika polypeptide are used to treat a subject affected by or at risk of infection by Zika virus. In other embodiments the antibodies thus prepared are used as a component of a diagnostic reagent.

Diagnostics

In some embodiments of the present invention, peptides identified as being unique to Zika virus may be expressed or synthesized as a component of a diagnostic aid or kit. In yet other embodiments the peptides which are diagnostic of Zika virus infection may be combined in the form of a diagnostic kit with distinct diagnostic peptides from co-endemic viruses from which differential diagnosis is needed. In some particular embodiments, such other viral peptides are from dengue viruses of serotypes 1-4, yellow fever, West Nile virus, Usutu virus.

One embodiment of the present invention provides a peptide-based diagnostic kit which enables differentiation between Zika virus infection and infection by dengue serotypes 1-4 or yellow fever, or prior vaccination by dengue or yellow fever. In yet additional preferred embodiments a peptide based diagnostic kit provides for differentiation between flavivirus infection, and other arboviruses including chikungunya virus. A further diagnostic kit allows differentiation of Zika and related flaviviruses from other potentially co-endemic organisms such as, but not limited to Saint Louis Encephalitis virus, hepatitis C, Japanese encephalitis virus, parvovirus 19, enteroviruses, Ross River virus, Eastern equine encephalitis, and *Plasmodium* spp.

Dengue

Some embodiments of the present invention also identify epitope mimics which arise in dengue virus and which bind to neurologic proteins. In some embodiments, the mimics are found in neuropeptide Y. In some specific embodiments, the epitope mimics identified are found only in dengue type 3. In yet other embodiments the mimics are found in isoforms of neural navigator protein 2. In some specific embodiments, the epitope mimics identified are found only in dengue type 1. In particular embodiments this invention includes synthetic polypeptides which comprise mutated epitopes of dengue virus that abrogate the mimic for a neural protein. Some embodiments provide for uses of the synthetic polypeptides comprising mutated dengue epitopes in the preparation of vaccines, therapeutics and diagnostics. Similarly, the invention includes the use of DNA and vectors which encode the synthetic polypeptides comprising mutated dengue epitopes and host cells which express them.

Usutu Virus

A further series of embodiments pertain to Usutu virus (USUV), an emerging flavivirus. These embodiments provide epitopes which may be used in diagnostic differentiation of this virus from other flaviviruses. In yet another embodiment potential epitope mimics in USUV are described enabling the design of a vaccine which avoids inclusion of such mimics. Some vaccine embodiments are based on NS1 while yet others are based on structural proteins.

Malaria Cross Reactivity

The present invention also relates to vaccine compositions for preventing Zika virus infection and disease. It also relates to monitoring the epidemiology of Zika virus. In particular, the present invention pertains to the design of interventions for Zika virus based on understanding of antibody stimulating epitopes in *Plasmodium* species which elicit antibodies which cross react with Zika virus and other flaviviruses.

In one embodiment of this invention, synthetic polypeptides and peptides are described which comprise pentameric and hexameric B cell epitopes of flaviviruses which match B cell epitopes in *Plasmodium* spp parasites. In some instances, the pentamer B cell epitopes are found in Zika virus, in other instances in a serotype of dengue virus or yellow fever. Matching B cell epitopes are found in *Plasmodium falciparum* or in *Plasmodium vivax*. However, these examples are not limiting and other species of *Plasmodium* such as, but not limited to, *P. ovale* and *P. malariae* may also carry flavivirus matching epitopes. In some particular embodiments, the Zika matching B cell epitopes are conserved in at least 10 diverse geographical isolates of *Plasmodium*. In some embodiments, the flavivirus B cell epitope is found in the envelope protein, in other embodiments in the NS1 protein and in yet other embodiments in other proteins encoded by the flavivirus polyprotein. In some embodiments, the synthetic peptide from *Plasmodium* may be 5 amino acids, in other instances it may be up to 16 amino acids and in yet other embodiments the peptide may be comprised within an extended polypeptide of up to 100 amino acids. In particular embodiments, the peptides comprising matching epitopes are unique to each particular flavivirus and *Plasmodium*, such that the *Plasmodium* matching peptides do not give rise to cross reactions between individual flaviviruses (eg. cross reactions between Zika and dengue). The present invention further provides for a host cell encoding the synthetic peptides or polypeptides carrying the B cell epitopes.

In a further group of embodiments the present invention is a vaccine which comprises immunogenic synthetic peptides of *Plasmodium* which elicit antibodies that provide neutralization of a particular flavivirus and protection to infection by the flavivirus. In some preferred embodiments the flavivirus is a Zika virus; in others it is a dengue virus and in yet others a yellow fever virus. In particular embodiments the immunogenic synthetic peptides are derived from *P falciparum* liver specific protein 1, a *Plasmodium falciparum* erythrocyte membrane protein or from *Plasmodium falciparum* conserved protein Pf3D71122600 or from PF3D7_1408700 conserved *Plasmodium* protein. In preferred embodiments the vaccine may be delivered to the subject to be protected as a soluble preparation, in other instances it is particulate. The vaccine immunogen peptide maybe encoded in a viral vector or in a nucleotide sequence, and in some particular embodiments may comprise a denatured or partially inactivated polypeptide. In some particular embodiments a vaccine immunogen peptide derived from a *Plasmodium* protein may be complemented by addition of a T helper epitope, a peptide which binds to an MHC II molecule, derived from Zika virus.

Having described a novel vaccine design comprising epitopes shared with *Plasmodium*, the present invention also provides, in another embodiment, a method for protecting a subject from infection or disease caused by a flavivirus by immunization with the vaccine. In one particular embodiment, the subject may be protected from Zika virus infection and disease; in other embodiments protection is desired from dengue or yellow fever.

In one embodiment, the present invention provides a means of diagnosis of specific flavivirus infections and differential diagnosis from prior malaria infection. In a further preferred embodiment it provides a diagnostic kit for conducting the differential diagnosis.

A further embodiment of the present invention is to provide a means of therapeutic intervention in flavivirus infection, and more particularly in Zika virus infection and disease by administration of antibodies to *Plasmodium*. In some particular embodiments the antibodies are elicited by epitopes in proteins of *P falciparum*; in yet other embodiments, the antibodies are elicited by epitopes in proteins of *P. vivax*. In particular instances the antibodies are elicited by *P falciparum* liver specific protein 1, by a *Plasmodium*

*falciparum* erythrocyte membrane protein or *Plasmodium* conserved protein Pf3D71122600 or *Plasmodium falciparum* PF3D7_1408700 conserved *Plasmodium* protein.

Intervention Via Plasmapheresis

By identifying the epitope mimics which elicit autoimmune effects of Zika virus, and the human c proteins in which such epitope mimics are found, the present invention enables the treatment of Zika virus disease, or disease caused by other flaviviruses including but not limited to dengue and USUV, by the administration of replacement proteins or peptides. It further enables the treatment of affected subjects by the administration of peptides or peptidomimetics which will bind to the immunoglobulins directed to the epitopes and thereby mitigate the antibody mediated pathogenesis. Such proteins, peptides or peptidomimetics may be administered to subjects who are pregnant and carrying a fetus at risk of Zika antibody mediated pathogenesis. In further embodiments, the proteins, peptides or peptidomimetics are administered to subjects who develop other neurologic deficits and retinal disorders as a sequel of Zika virus infection. In yet other embodiments the proteins, peptides or peptidomimetics may be administered to subjects who are suffering from Guillain Barre like symptoms.

In yet further embodiments the peptides identified in Zika virus and in other flaviviruses as epitope mimics are used ex vivo as a medium for binding and removing reactive antibodies from plasma of a subject affected by a clinical manifestation of flavivirus infection. In some embodiments the mimic peptides are used alone, in other embodiments the peptides are linked via a tag (including but not limited to a histag or a FLAG tag) to a substrate. In some particular embodiments, the peptides, or peptidomimetics, thereof are used in plasmapheresis of a subject affected by a clinical manifestation of a Zika virus infection, including but not limited to Guillain Barré syndrome.

B Cell Ablation

A further embodiment described in the present invention is the elimination of B cell clones which make antibodies that target epitopes shared by flaviviruses, including but not limited to Zika, USUV, or dengue virus, and by a human protein. In particular embodiments the epitopes identified herein are fused to a cytocide or cytotoxin, which may or may not be radioactive, and the fusion the administered to a subject exposed to the flavivirus with the intent of specifically binding and killing reactive B cells.

Mutated Human Proteins

In some embodiments of the present invention, synthetic polypeptides are described which are derived from neural proteins and which incorporate amino acid mutations that mimic epitopes also found in Zika or dengue virus. In some particular embodiments the synthetic polypeptides are derived from the prepropeptide of neuropeptide Y. The synthetic polypeptides are used, in one embodiment, as a diagnostic aid for identification of prior Zika or dengue virus infections, and may be accompanied by controls which comprise abrogated or scrambled mimic epitopes.

In some embodiments of the present invention a synthetic peptide is expressed that is derived from a neurologic protein that contains an epitope mimic matching an epitope in Zika virus. Such synthetic polypeptides may include, for example, the native pentamer mimic motif or may have this replaced by a substitute pentamer or by a scrambled version of the mimic pentamer. In some preferred embodiments, the neurologic protein is drawn from the group comprising neuropeptide Y or neural navigator protein 2 (NAV2). In some embodiments, the synthetic polypeptides are then used in a serologic assay to detect antibodies to Zika, which also bind to the human proteins and which are thus indicators of potential adverse effects including, but not limited, to GBS and Zika fetal syndrome. Detection of such antibodies are used as a marker of risk or a surrogate marker for GBS and other neurologic sequelae of Zika infection.

EXEMPLARY EMBODIMENTS

For example, in some embodiments, the present invention provides a synthetic Zika virus polypeptide comprising one or more B cell epitopes and one or more peptides that each bind with high affinity to three or more different WIC II molecules. In some embodiments, the polypeptide comprises B cell epitopes that are unique to Zika virus and do not elicit antibodies which cross react with a dengue virus. In some embodiments, the polypeptide comprises one or more altered or deleted epitope mimic sequences so that the sequence of the synthetic Zika virus polypeptide is altered in comparison to the corresponding wild type Zika virus polypeptide (e.g., the polypeptide comprising one or more altered or deleted epitope mimic sequences comprises a deletion or substitution mutation of one or more amino acids in the epitope mimic sequence so that the sequence of synthetic Zika virus polypeptide is altered in comparison to the corresponding wild type Zika virus polypeptide). In some embodiments, the epitope mimic sequence is found in a human neurologic protein (e.g., a human neurologic protein listed in tables 1, 6, 7, 8 or 9). In some embodiments, the epitope mimic sequences are selected from, for example, SEQ ID NOs: 1-34, 78-140, or 255-256. In some embodiments, the synthetic polypeptide comprises a Zika virus immunogen from an envelope polypeptide of Zika virus (e.g., Zika virus Domain I, Domain II, or Domain III polypeptides). In some embodiments, the Zika virus immunogen is an immunogen encoded by an amino acid sequence selected from, for example, amino acids 38-444 of SEQ ID NO: 142, amino acids 38-143 of SEQ ID NO: 144, amino acids 38-125 of SEQ ID NO: 146, amino acids 38-113 of SEQ ID NO: 148, amino acids 24-429 of SEQ ID NO: 150, amino acids 24-128 of SEQ ID NO: 152, amino acids 24-110 of SEQ ID NO: 154, amino acids 24-98 of SEQ ID NO: 156, amino acids 30-435 of SEQ ID NO: 158, amino acids 30-134 of SEQ ID NO: 160, amino acids 30-116 of SEQ ID NO: 162, amino acids 30-104 of SEQ ID NO: 164, amino acids 38-143 of SEQ ID NO: 166, amino acids 24-128 of SEQ ID NO: 168, amino acids 30-134 of SEQ ID NO: 170, or amino acids 38-444 of SEQ ID NO: 254. In some embodiments, the epitope mimic sequence is found in a human microcephaly associated protein (e.g., CDKRAP2, ASPM, or CEP135). In some embodiments, the epitope mimic sequence is selected from the group of epitope mimic sequences identified by SEQ ID NOs: 452-456. In some embodiments, the synthetic polypeptide comprises a Zika virus immunogen from a Zika virus protein selected from PrM, NS1, NS3, or NS4B. In some embodiments, the Zika virus immunogen is an NS1 immunogen encoded by an amino acid sequence selected from, for example, amino acids 21 to 384 of SEQ ID NO:441, amino acids 21 to 213 of SEQ ID NO:443 or amino acids 21 to 213 of SEQ ID NO:445.

Further embodiments provide a synthetic flavivirus NS1 polypeptide comprising one or more B cell epitopes and that comprise peptides that bind with high affinity to three or more different MEW II molecules. In some embodiments, the polypeptide is selected from, for example, a dengue virus NS1 polypeptide, Zika virus NS1 polypeptide, West Nile virus NS1 polypeptide, Yellow fever virus NS1 polypeptide, Usutu virus NS1 polypeptide, Japanese encephalitis virus NS1 polypeptide, Tickborne encephalitis virus NS1 polypeptide, or St Louis encephalitis virus NS1 polypeptide. In some embodiments, the polypeptide comprises one or more altered or deleted epitope mimic sequences so that the sequence of the synthetic polypeptide is altered in comparison to the corresponding wild type virus polypeptide. In some embodiments, the polypeptide comprising one or more altered or deleted epitope mimic sequences comprises a deletion or substitution mutation of one or more amino acids in the epitope mimic sequence so that the sequence of the synthetic virus polypeptide is altered in comparison to the corresponding wild type virus polypeptide. In some embodiments, the epitope mimic sequence matches an epitope motif in a human cardiovascular protein (e.g., a human protein expressed in vascular endothelium or in platelets). In some embodiments, the human cardiovascular protein is selected from, for example, ADAMTS13, Coagulation factor V, Coagulation factor VIII, Plasminogen, Platelet glycoprotein Ib beta chain, Vascular endothelial growth factor A, Vascular endothelial growth factor B, Vascular endothelial growth factor receptor 1, Vascular endothelial growth factor receptor 2, von Willebrand factor or Platelet endothelial aggregation receptor 1. In some embodiments, the epitope mimic sequences are selected from the group of epitope mimic sequences identified by SEQ ID NOs:1106-1123. In some embodiments, the epitope mimic sequence matches an epitope motif in a human protein with neurologic function. In some embodiments, the epitope mimic sequences are selected from, for example, SEQ ID NOs:1124-1125 and 1138-1149. In some embodiments, the synthetic polypeptide comprises Zika PrM and Env proteins in operable linkage. In some embodiments, the polypeptide is encoded by amino acids 25 to 603 of SEQ ID NO:258, amino acids 25 to 603 of SEQ ID NO:260, or amino acids 25 to 603 of SEQ ID NO:262. In some embodiments, the synthetic polypeptide comprises one or more altered or deleted pan-flavivirus epitopes so that the sequence of the synthetic Zika virus polypeptide is altered in comparison to the corresponding wild type Zika virus polypeptide. In some embodiments, the pan-flavivirus epitope is DRGWG (SEQ ID NO:554).

Further embodiments provide a fusion protein comprising the synthetic polypeptides described herein. In some embodiments, the fusion protein comprises a peptide sequence selected from a signal sequence, a linker sequence, a purification tag sequence and an immunoglobulin sequence in operable association with the synthetic polypeptide. In some embodiments, the peptide sequence is exogenous to the synthetic polypeptide sequence. In some embodiments, the immunoglobulin sequence is a constant region sequence.

Yet other embodiments provide a nucleic acid or a vector comprising a nucleic acid sequence encoding a synthetic polypeptide or fusion protein described herein. In some embodiments, the nucleic acid sequence encoding a synthetic polypeptide or fusion protein is operably linked to an exogenous promoter.

Still other embodiments provide a host cell comprising the vector or nucleic acid described herein.

Certain embodiments provide a vaccine comprising a synthetic peptide or fusion protein described herein and a pharmaceutically acceptable carrier. In some embodiments, the vaccine further comprises an adjuvant. In some embodiments, the vaccine is a soluble formulation. In some embodiments, the vaccine is provided as a particulate delivery vehicle. In some embodiments, the synthetic peptide or fusion protein is incorporated into a viral vector (e.g., a chimeric or pseudotyped viral particle). In some embodiments, the chimeric or pseudotyped virus comprises a viral protein of a virus that is heterologous to the synthetic polypeptide or fusion protein, or the synthetic polypeptide or fusion protein is displayed on a surface of a heterologous viral particle. In some embodiments, the synthetic polypeptide or fusion protein comprises more than one scrambled mimics or a pentamer that each replaces an epitope mimic sequence.

In some embodiments, the present invention provides a DNA vaccine comprising a nucleic acid sequence described herein. In some embodiments, the nucleic acid is incorporated into a chimeric or pseudotyped viral particle. In some embodiments, the vaccine is naked DNA. In some embodiments, the nucleic acid is in a eukaryotic expression vector or an adenoviral vector. In some embodiments, the vaccine comprises the nucleic acid inserted into an attenuated flavivirus genome (e.g., yellow fever virus). In some embodiments, the nucleic acid is in a virus like particle.

In further embodiments, the present invention provides an antibody prepared by immunization of a subject with a synthetic polypeptide described herein. In some embodiments, the antibody comprises an immunoglobulin from which the Fc binding region has been removed.

In yet other embodiments, the present invention provides a diagnostic system for detection of antibodies to flavivirus virus comprising one or more synthetic peptide epitopes of Zika virus immobilized on a solid or semisolid support. In some embodiments, the solid or semisolid support is selected from, for example, a bead, a chip, a tube, or a multiwell plate. In some embodiments, the one or more synthetic peptide epitopes are covalently attached to the solid or semisolid support. In some embodiments, the one or more synthetic peptide epitopes are attached to the solid or semisolid support via a linker. In some embodiments, the solid or semisolid support is functionalized or treated to facilitate the immobilization. In some embodiments, one or more synthetic peptide epitopes comprise epitopes specific for serum antibodies of Zika virus and epitopes specific for serum antibodies of other flaviviruses (e.g., Dengue virus serotypes, West Nile virus, and Yellow Fever virus, or Usutu virus). In some embodiments, the one or more epitopes are specific for serum antibodies of flaviviruses and do not bind to serum antibodies from Chikungunya virus. In some embodiments, the synthetic peptides correspond to envelope proteins of one or more flaviviruses (e.g., NS1). In some embodiments, one or more synthetic peptide epitopes comprise the pentamer ESTEN (SEQ ID NO: 31), SEQ ID NO:172 or 173, or the pentamer STTAS (SEQ ID NO:1239). In some embodiments, the one or more synthetic epitopes are selected based on having competitive B cell binding in the top 10% of all peptides from the protein from which they are derived. In some embodiments, the one or more synthetic epitopes are selected to bind to antibodies with a dissociation constant less than $10^{-7}$M. In some embodiments, the peptides are pentamers. In some embodiments, the pentamers are flanked by regions of 5-10 amino acids each side of the pentamer. In some embodiments, the peptides are selected from peptides listed in Table 12, Table 16 and Table 17 and the system further comprises: a. 1 to 4 pentamers each of which is specific to Zika virus; b. 1 to 4 pentamers each of which is specific to dengue serotype 1; c. 1 to 4 pentamers each of which is specific to dengue serotype 2; d. 1 to 4 pentamers each of which is specific to dengue serotype 3; e. 1 to 4 pentamers each of which is specific to dengue serotype 4, and f 1 to 4 pentamers each of which is specific to yellow fever. In some embodiments, the peptides are pentamers selected from SEQ ID NOs: 263-391, 519-589, 647-70, and 1247-1256 or combinations thereof. In some embodiments, the peptides are 15-mers and selected from SEQ ID NOs: 446-518 and 590-646 or combinations thereof. In some embodiments, the system further comprises: a. 1 to 4 peptides each of which is specific to West Nile virus and b. 1 to 4 peptides each of which is specific to Chikungunya virus. In some embodiments, the system comprises one or more synthetic peptides comprising B cell epitopes located in Domain I, Domain II or Domain III of the envelope protein of Zika virus. In some embodiments, the epitopes cross reacting with dengue or yellow fever have been removed or mutated from the Zika virus synthetic polypeptides. In some embodiments, the synthetic polypeptides comprise a sequence selected from SEQ ID NOs. 393, 395 or 397. In some embodiments, the diagnostic system comprises at least 3 different synthetic polypeptide sequences in the configuration CXXRGXXXRXTTXXGXXXXXWC (SEQ ID NO: 1245), wherein X is any amino acid. In some embodiments, the diagnostic system further comprises three or more synthetic polypeptides of the sequences selected from SEQ ID NOs. 1138-1149 or 1150-1160. In some embodiments, the system further comprises one or more polypeptides peptides from at least one additional flavivirus immobilized on a solid or semisolid support. In some embodiments, the synthetic peptide epitopes facilitate differentiation of serum antibodies to Zika virus and *Plasmodium* spp. In some embodiments, the system comprises synthetic peptide epitopes that bind to serum antibodies to Zika virus but not to serum antibodies to *Plasmodium* spp. In some embodiments, the system comprises synthetic peptide epitopes that bind to serum antibodies to *Plasmodium* spp. but not to serum antibodies to Zika virus. In some embodiments, the diagnostic system further comprises a. a set of one or more peptides comprising pentamers selected from SEQ ID NOs.: 705-758 and b. one or more pan-flavi peptides selected from SEQ ID NOs.: 552-559.

In other embodiments, the present invention provides a diagnostic system comprising one or more peptides selected from SEQ ID NOs.: 1058-1093 or a pan-flavivirus peptide comprising the amino acid sequences DRGWG (SEQ ID NO.: 554) or RGWGN (SEQ ID NO.: 1257).

In certain embodiments, the present invention provides a diagnostic system for detection of antibodies to Usutu virus comprising one or more peptides selected from SEQ ID NOs.: 1219-1230 or 1231-1238 immobilized on a solid or semisolid support. In some embodiments, the synthetic peptide epitopes are each fused to a linker (e.g., a histag or a FLAG tag or biotin). In some embodiments, the peptides are affixed directly or indirectly to the solid or semi solid substrate. In some embodiments, the diagnostic systems further comprise a second antibody specific for human antibodies or non-human antibodies. In some embodiments, the second antibody is detectably labelled. In some embodiments, the second antibody detects either bound human IgG or IgM. In some embodiments, the second antibody detects a bound antibody of a non-human species.

In some embodiments, the present invention provides for the use of the diagnostic systems described above for the diagnosis of infection by a flavivirus, including, but not limited to, Zika virus, Dengue virus, West Nile virus, Yellow Fever virus, or Usutu virus.

In still further embodiments, the present invention provides a synthetic polypeptide comprising a variant dengue envelope protein having one or more altered or deleted epitope mimic sequences so that the sequence of the synthetic variant dengue envelope protein is altered in comparison to the corresponding wild type dengue virus protein. In some embodiments, the polypeptide comprising one or more altered or deleted epitope mimic sequences comprises a deletion or substitution mutation of one or more amino acids in the epitope mimic sequence so that the sequence of synthetic polypeptide is altered in comparison to the corresponding wild type polypeptide. In some embodiments, the epitope mimic sequence matches an epitope motif in a neurologic protein (e.g., neuropeptide Y or neural navigator protein 2). In some embodiments, the epitope mimic sequence is GEDAP (SEQ ID NO: 38) or TDKEK (SEQ ID NO: 56).

In yet other embodiments, the present invention provides a chimeric or pseudotyped viral particle comprising the synthetic polypeptides described herein.

Further provided herein is a synthetic Usutu virus structural polypeptide comprising one or more B cell epitopes and one or more peptides that each bind with high affinity to 3 or more different MEW II molecules. In some embodiments, the polypeptide comprises one or more altered or deleted epitope mimic sequences so that the sequence of the synthetic Usutu virus polypeptide is altered in comparison to the corresponding wild type Usutu virus polypeptide. In some embodiments, the polypeptide comprising one or more altered or deleted epitope mimic sequences comprises a deletion or substitution mutation of one or more amino acids in the epitope mimic sequence so that the sequence of synthetic Usutu virus polypeptide is altered in comparison to the corresponding wild type Usutu virus polypeptide. In some embodiments, the epitope mimic matches an epitope motif in a human protein with cardiovascular function, neurologic function, or microcephaly related protein. In some embodiments, the epitope mimic sequence is selected from SEQ ID NOs.: 1161-1210. In some embodiments, the synthetic polypeptide is amino acids 24 to 523 of SEQ ID NO.:1212 or amino acids 24 to 523 of SEQ ID NO: 1216.

Also provided herein is a *Plasmodium* synthetic polypeptide or peptide comprising a pentamer amino acid sequence also found in a B cell epitope peptide of a flavivirus. In some embodiments, the pentamer amino acid sequence is found in a B cell epitope of a flavivirus envelope protein or a flavivirus NS1 protein. In some embodiments, the polypeptide or peptide is from 5 to 100 amino acids in length. In some embodiments, the *Plasmodium* species is *P. falciparum* or *P. vivax*. In some embodiments, the polypeptide or peptide is derived from the *Plasmodium vivax* and *Plasmodium falciparum* proteins listed in Tables 20 to 23. In some embodiments, the polypeptide or peptide is derived from *Plasmodium falciparum* liver specific protein 1, or *Plasmodium* conserved protein Pf3D71122600 or PF3D7_1408700 conserved *Plasmodium* protein. In some embodiments, the polypeptide or peptide comprises a pentamer selected from SEQ ID NOs.: 705-738. In some embodiments, the polypeptide or peptide comprises a pentamer selected from SEQ ID NOs.: 739-758, NOs.: 647, 759-964 or 965-1057 and 1246. In some embodiments, the polypeptide or peptide comprises a 15-mer or 16 mer amino acid sequence selected from SEQ ID NOs.: 1058-1093. In some embodiments, the polypeptide or peptide comprises amino acids 24 to 84 of SEQ ID NO.: 1095. In some embodiments, the synthetic polypeptide or peptide is operably linked to a synthetic peptide sequence comprising a T cell epitope from Zika virus. In some embodiments, the polypeptide or peptide comprises amino acids 22 to 94 of SEQ ID NO.: 1105. In some embodiments, immunization with the synthetic polypeptide or peptide elicits antibodies binding Zika virus which do not cross react with dengue virus or Yellow fever virus.

Yet other embodiments provide a method of protecting a subject at risk of contracting Zika virus disease by vaccinating with a vaccine as described herein.

Provided herein is the use of a vaccine described herein to immunize a subject.

Further provided herein is a method of differentiating a prior infection by Zika virus from a prior malaria infection comprising assaying the binding of serum antibodies of a subject to a set of one or more peptides comprising pentamers selected from SEQ ID NOs.: 705 to 758 or one or more pan flavi peptides selected from SEQ ID NOs.: 552-559.

Also provided herein is a plasmapheresis substrate comprising a solid or semi-solid support selected from a particle, a filter, a gel, or a mesh comprising synthetic peptide or polypeptide which binds to an antibody elicited by a flavivirus protein epitope mimic for a human protein, wherein the plasma of a subject affected by the flavivirus is exposed and to which antibodies therein are bound. In some embodiments, the peptide is derived from an envelope protein or an NS1 protein. In some embodiments, the flavivirus is a Zika virus a dengue virus, or an Usutu virus. In some embodiments, the human protein is a protein with neurologic function or cardiovascular function.

In still other embodiments, the present invention provides a method of removing antibodies from a subject in need thereof comprising contacting the serum of the patient with the plasmapheresis substrate described herein so that the antibodies are bound and returning the serum to the patient.

Provided in certain embodiments is a method of ablation of B cells that are producing antibodies reactive with epitope mimics shared by a flavivirus and a human protein comprising: preparing a fusion polypeptide comprising an epitope mimic peptide fused to a cytocide or cytotoxin; and administering the fusion polypeptide to a subject. In some embodiments, the epitope mimic is derived from an envelope protein or an NS1 protein of a flavivirus (e.g., a Zika virus, a dengue virus, or an Usutu virus). In some embodiments, the human protein is a protein with neurologic function or cardiovascular function. In some embodiments, the epitope mimic peptide is one or more of SEQ ID NOs.: 1-140, 255-256, 1106-1125 or 1138-1149. In some embodiments, the fusion polypeptide further comprises a peptide with the configuration CXXRGXXXRXTTXXGXXXXXWC (SEQ ID NO: 1245), wherein X is any amino acid.

Provided in some embodiments is a fusion polypeptide comprising an epitope mimic peptide of a flavivirus fused to a cytocide or cytotoxin.

In some embodiments, provided herein is a synthetic polypeptide derived from a human neurologic protein comprising one or more altered or deleted epitope mimic sequences so that the sequence of the synthetic polypeptide is altered in comparison to the corresponding wild type neurologic protein and wherein the epitope mimic sequence is shared with a B cell epitope in a Zika virus or dengue virus.

In other embodiments, the present invention provides a synthetic human neurological polypeptide comprising one or more altered or deleted epitope mimic sequences so that the sequence of the synthetic neurological polypeptide is altered in comparison to the corresponding wild type neurological polypeptide and wherein the epitope mimic sequence is shared with a B cell epitope in a Zika virus or dengue virus. In some embodiments, the polypeptide comprising one or more altered or deleted epitope mimic sequences comprises a deletion or substitution mutation of one or more amino acids in the epitope mimic sequence so that the sequence of synthetic neurological polypeptide is altered in comparison to the corresponding wild type neurological polypeptide. In some embodiments, the human neurological polypeptide is proneuropeptide Y or neuron navigator 2. In some embodiments, the polypeptide comprises an amino acid sequence selected from, for example, amino acids 35-104 of SEQ ID NO:174, amino acids 35-104 of SEQ ID NO:176, amino acids 35-104 of SEQ ID NO:178, amino acids 35-104 of SEQ ID NO: 180, amino acids 35-104 of SEQ ID NO:182, amino acids 30-270 of SEQ ID NO:236, amino acids 30-270 of SEQ ID NO:238, amino acids 30-270 of SEQ ID NO:240, amino acids 30-270 of SEQ ID NO:242, amino acids 30-280 of SEQ ID NO:244, amino acids 30 to 269 of SEQ ID NO.: 399, amino acids 30 to 269 of SEQ ID NO.:401, amino acids 30 to 269 of SEQ ID NO.:403, amino acids 30 to 269 of SEQ ID NO.:405, amino acids 30 to 279 of SEQ ID NO.:407, amino acids 268 to 507 of SEQ ID NO.:409, amino acids 268 to 507 of SEQ ID NO.:411, amino acids 268 to 507 of SEQ ID NO.:413, amino acids 268 to 507 of SEQ ID NO.:415, amino acids 268 to 507 of SEQ ID NO.:417, amino acids 30 to 100 of SEQ ID NO.:419, amino acids 30 to 100 of SEQ ID NO.:421, amino acids 30 to 100 of SEQ ID NO.:423, amino acids 30 to 100 of SEQ ID NO.:425, amino acids 30 to 110 of SEQ ID NO.:427, amino acids 268 to 338 of SEQ ID NO.:429, amino acids 268 to 338 of SEQ ID NO.:431, amino acids 268 to 338 of SEQ ID NO.:433, amino acids 268 to 338 of SEQ ID NO.:435, or amino acids 268 to 348 of SEQ ID NO.:437.

Other embodiments provide a synthetic polypeptide derived from a human microcephaly associated protein comprising one or more altered or deleted epitope mimic sequences so that the sequence of the synthetic polypeptide is altered in comparison to the corresponding wild type human microcephaly associated protein and wherein the epitope mimic sequence is shared with a B cell epitope in a Zika virus or dengue virus. In some embodiments, the polypeptide comprising one or more altered or deleted epitope mimic sequences comprises a deletion or substitution mutation of one or more amino acids in the epitope mimic sequence so that the sequence of synthetic polypeptide is altered in comparison to the corresponding wild type human microcephaly associated protein (e.g., ASPM).

Further embodiments are described herein.

A: From Cavalcanti et al, Journal of Infection in Developing Countries, 2016 Distribution of reported Zika microcephaly cases in Brazil. B. Distribution of *P. falciparum* distribution in Brazil. C. Distribution of *P. falciparum* distribution globally.

Figure 5:
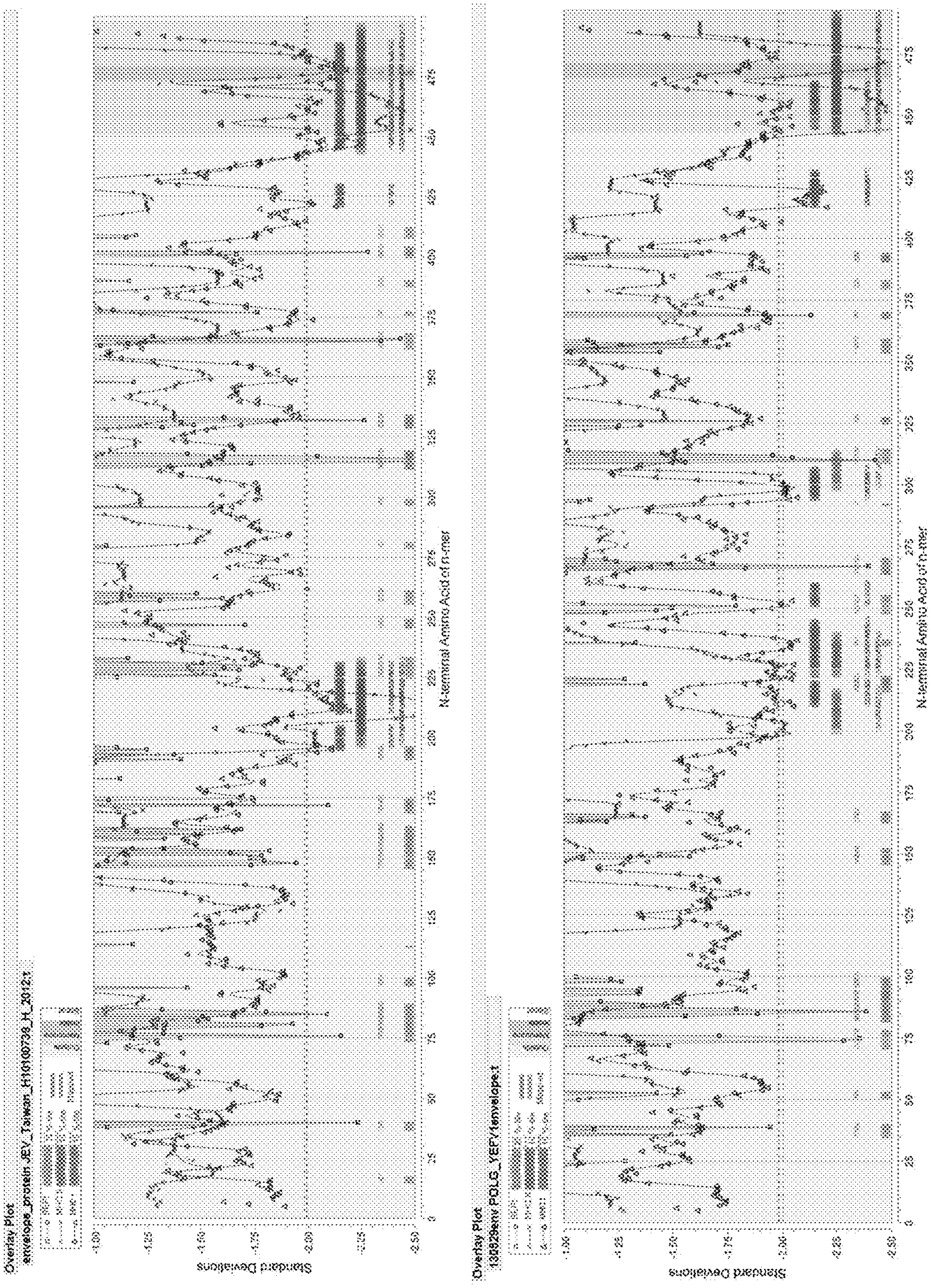

FIG. 5. Comparative envelope epitope for JEV (top) and yellow fever (bottom), both reference strains. In this population permuted plot: Predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).

Figure 6:
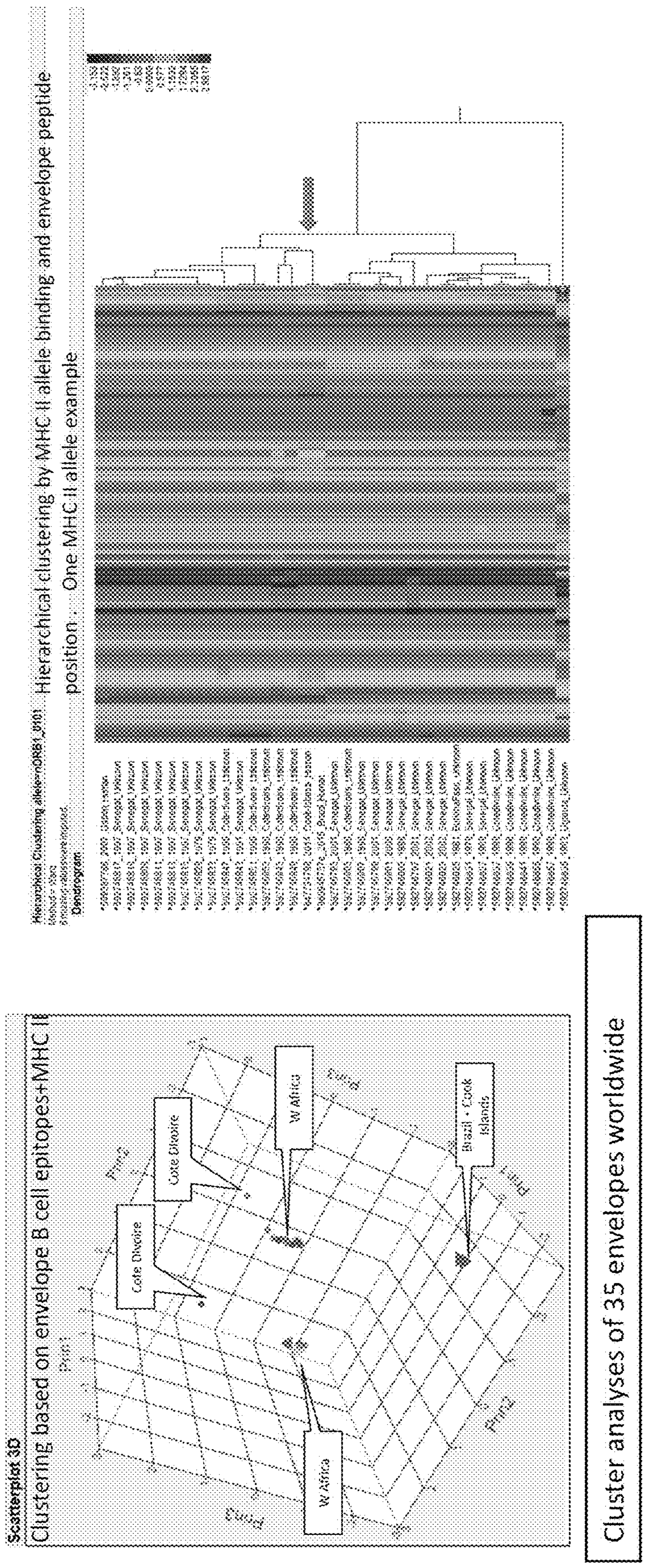

FIG. 6. Cluster analyses of 35 envelopes worldwide.

Figure 7:
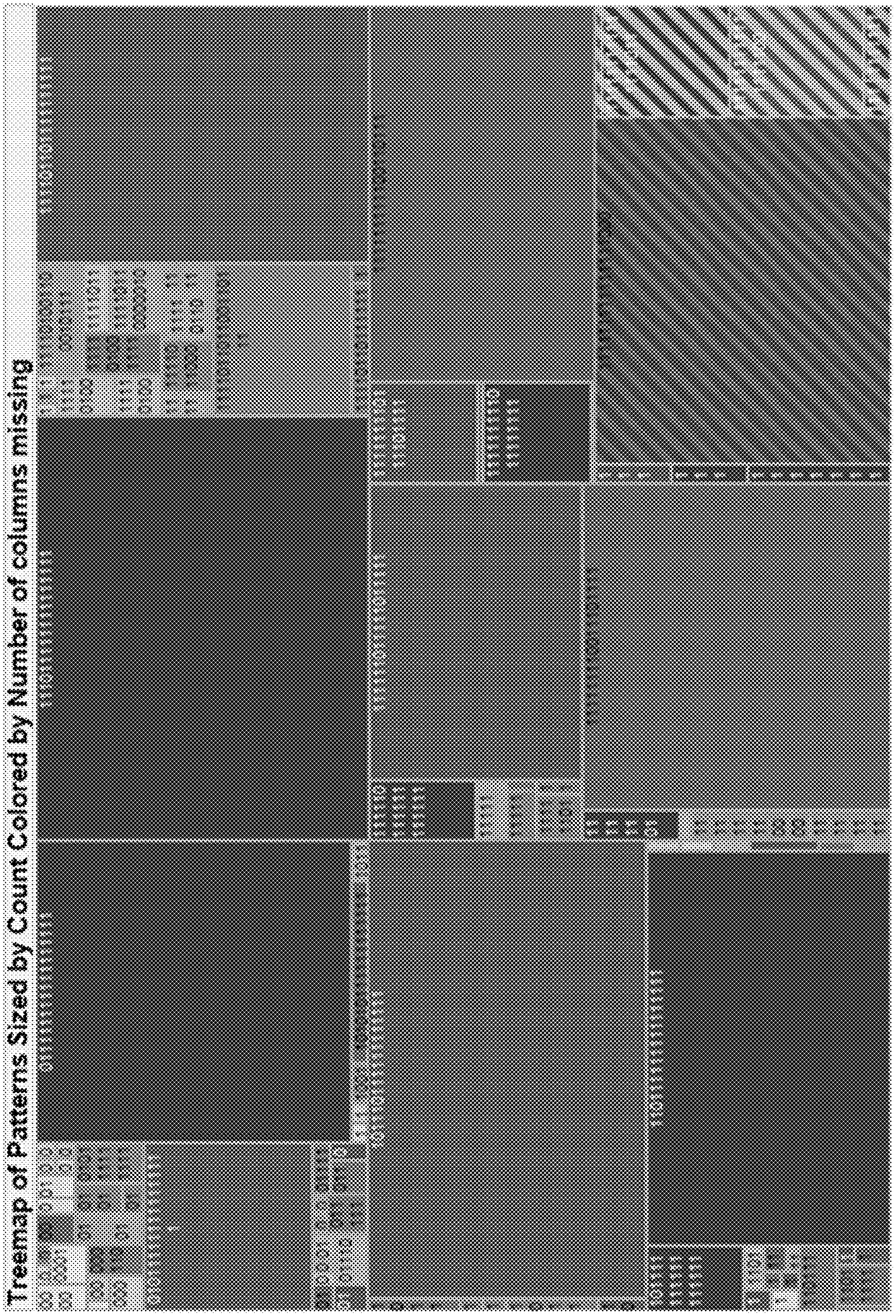

FIG. 7. Sharing pattern of pentamer motifs among 18 Flavivirus envelopes. Motifs in hatched boxes are those exclusive to the 3 Zika isolates analyzed.

Figure 8:
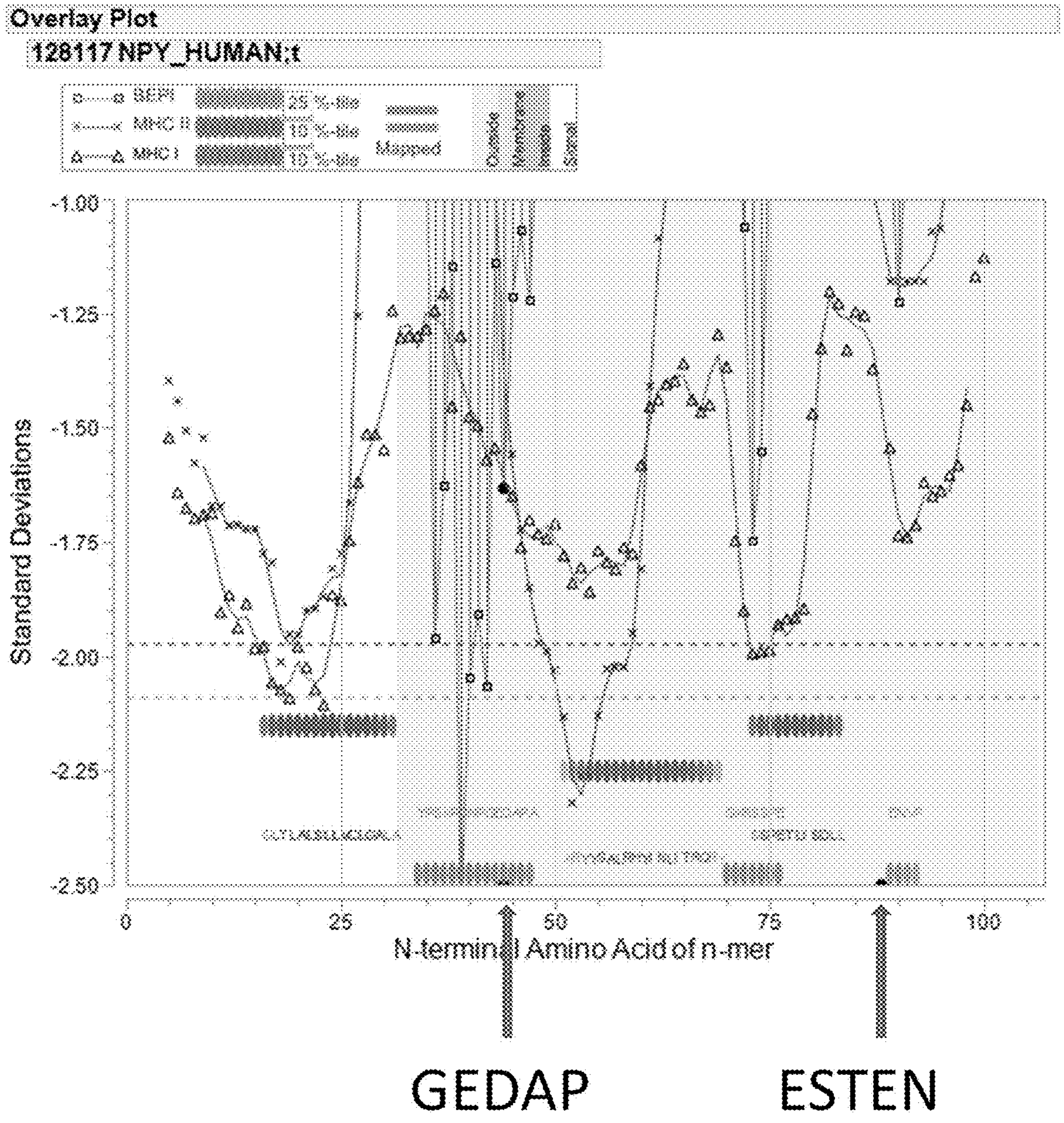

FIG. 8. NPY Binding sites of mimic antibodies from Dengue 3 (GEDAP (SEQ ID NO.: 38)) and Zika (ESTEN (SEQ ID NO.: 31)).

Figure 9:
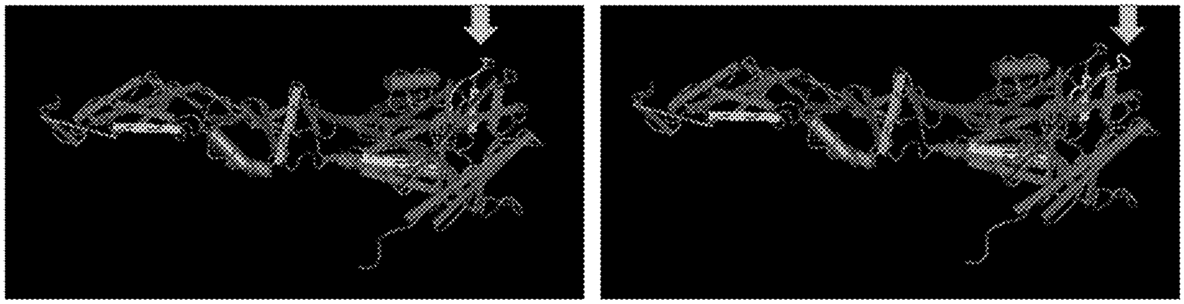

FIG. 9. Mock-up of projected position of motifs in Domain 3 using JEV as a structural model.

Figure 10:
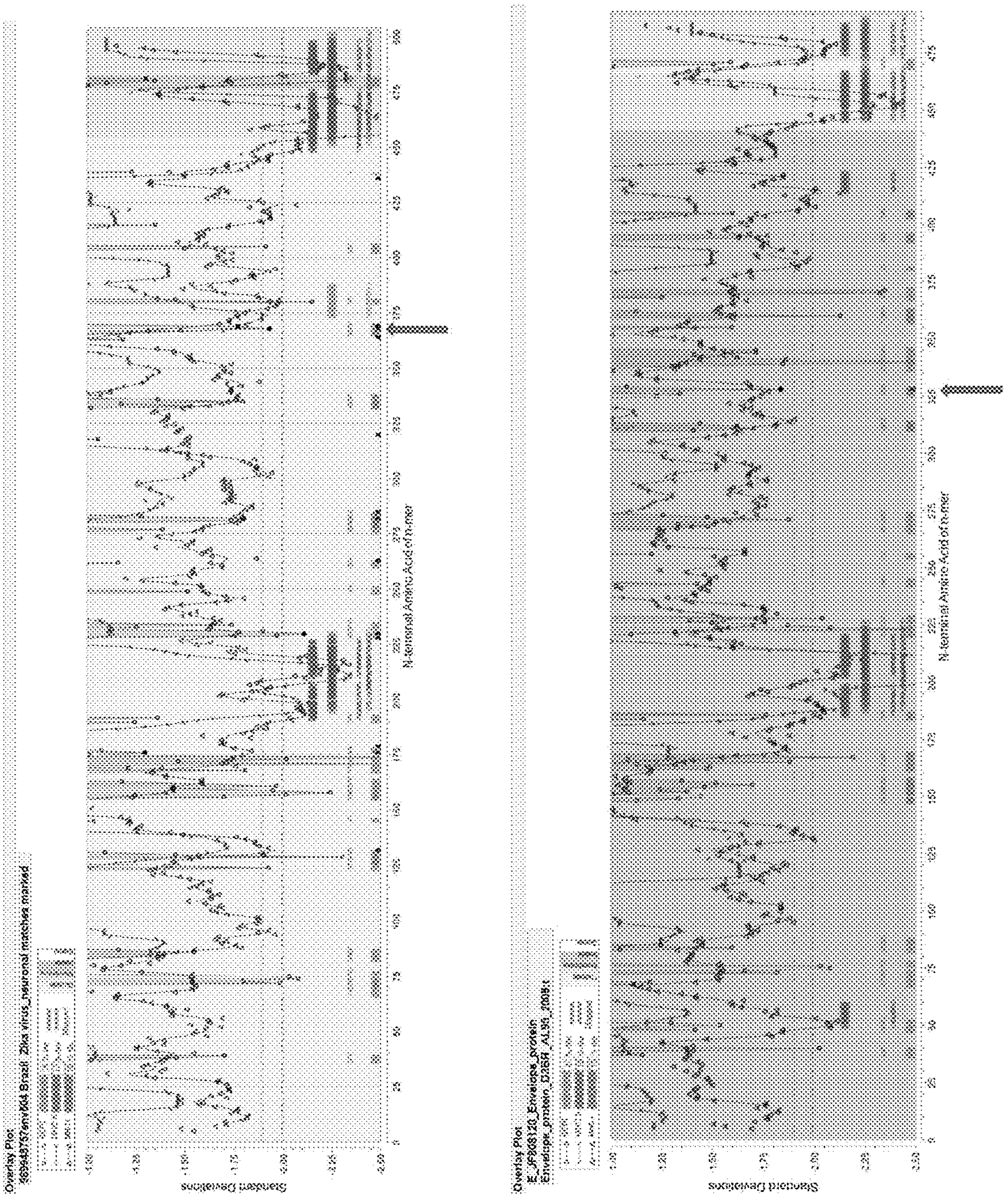

FIG. 10. Top: Zika virus envelope protein showing NPY match "ESTEN" (SEQ ID NO.: 31) marked by arrow. Not it is associated with adjacent MHC II binding (blue line). Bottom: DEN3 isolate with NPY match "GEDAP" (SEQ ID NO.: 38) motif marked.

Figure 11:
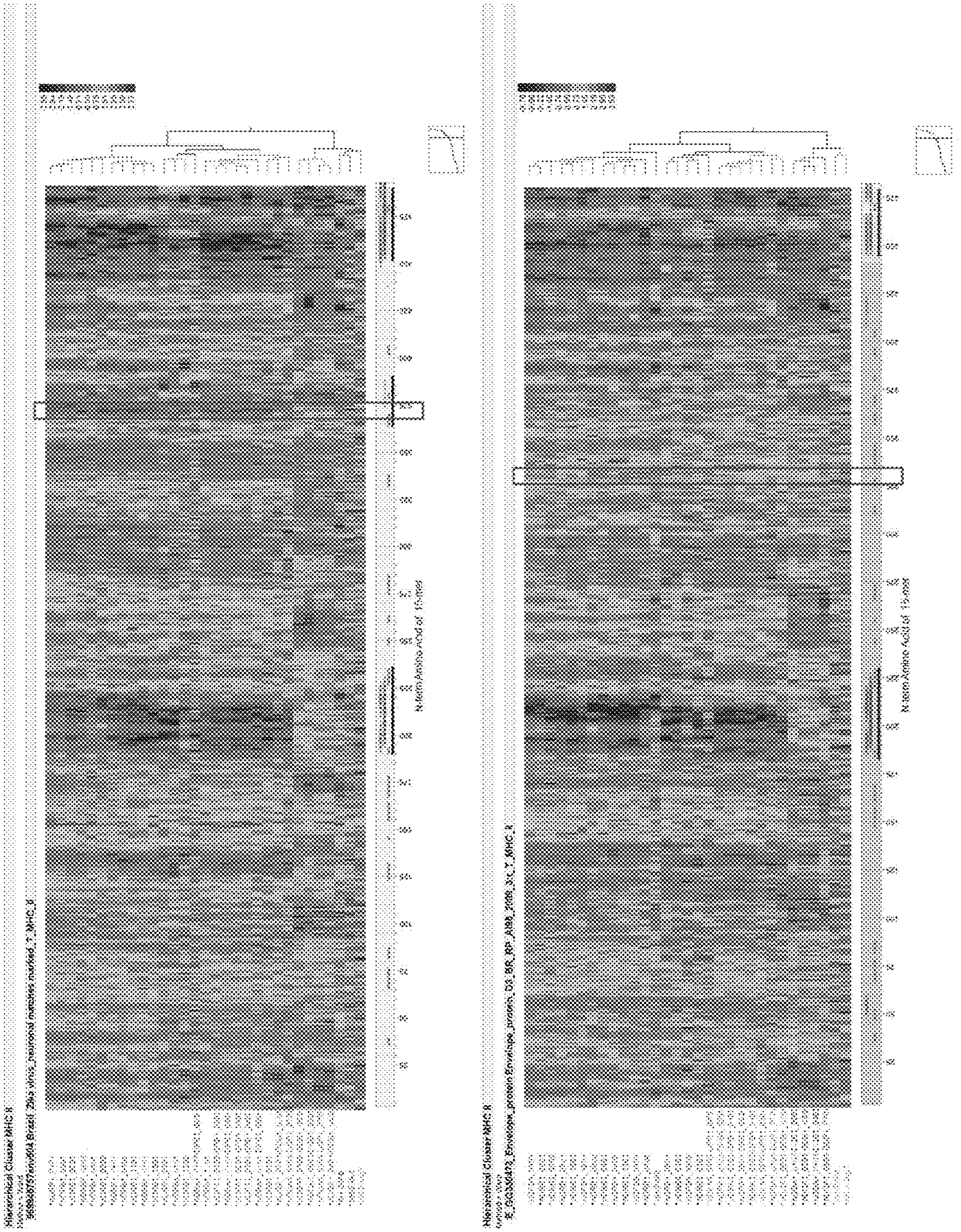

FIG. 11. Top: Zika, Bottom Den 3 showing difference in MEW II binding adjacent to pentamer motifs of interest located in pink box. This figure shows a hierarchical cluster of predicted binding of peptides to individual MHC-II alleles. On the X axis 15-mer peptides respectively are indexed to their N terminal positions. Y axis indicates HLA alleles clustered by similarity of binding. Color index of pixels shows predicted binding affinity in standard deviations units (blue high affinity). Shows HLA which react similarly, as well as variability in binding affinity by peptide.

FIG. 12. Shows the position of the KGLRS (SEQ ID NO.: 1258) mimic in Zika envelope Domain I and the TDKEK (SEQ ID NO.: 56) motif in dengue type 1 envelope Domain I using a Japanese encephalitis structural model as a surrogate model.

Figure 13:
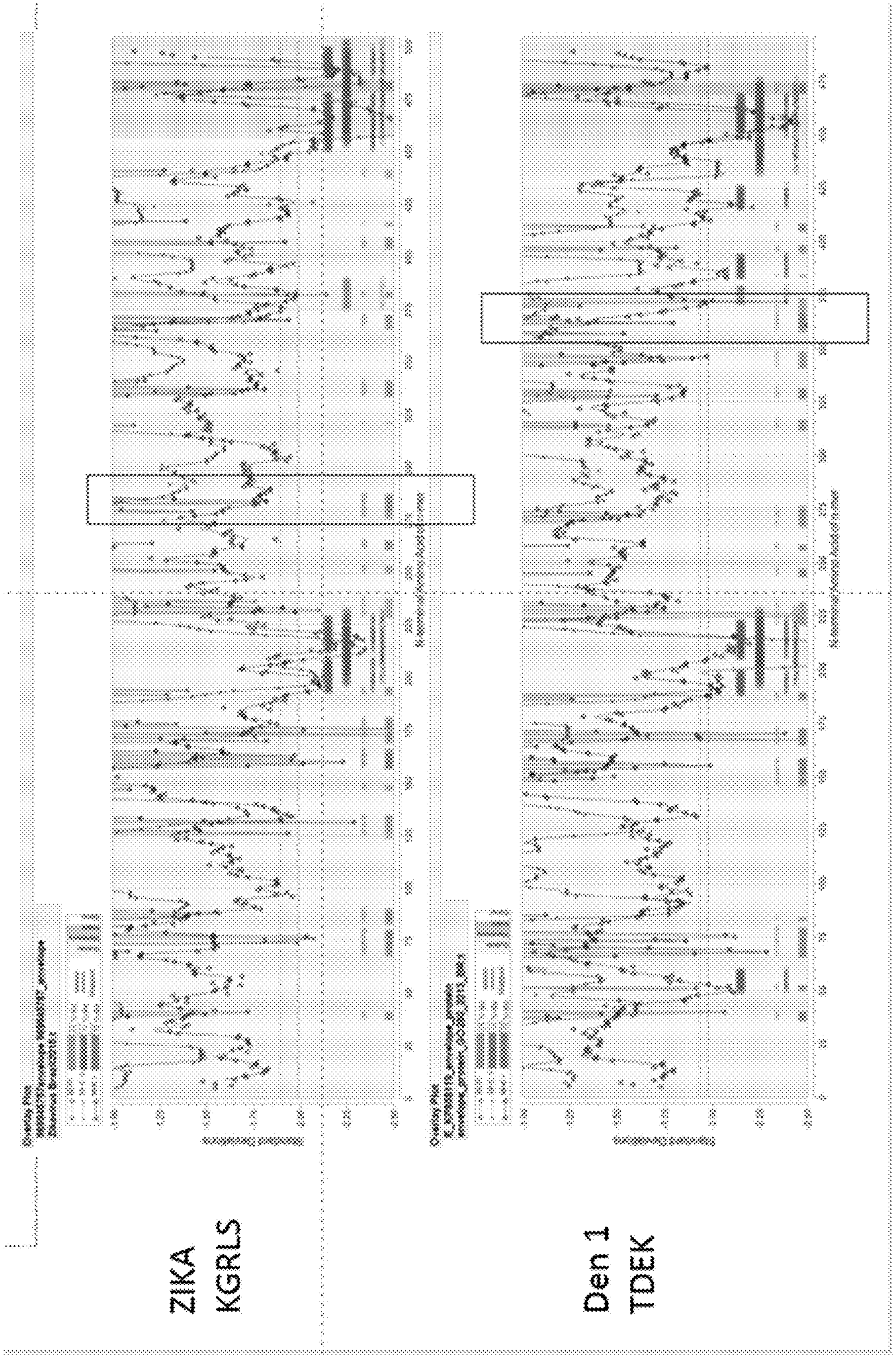

FIG. 13. Shows the position of the KGLRS (SEQ ID NO.: 1258) mimic in Zika and the TDKEK (SEQ ID NO.: 56) motif in dengue type 1

Figure 14:
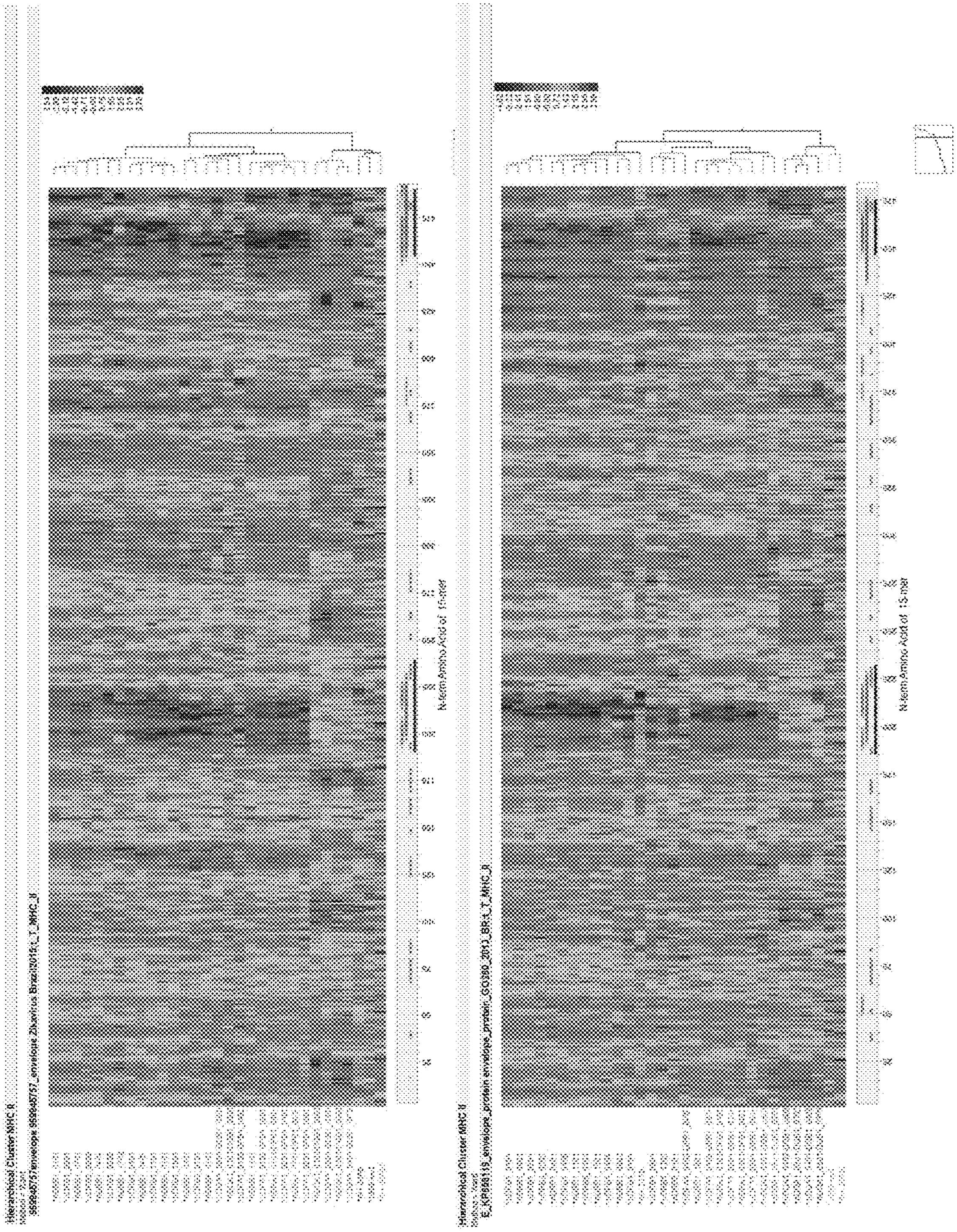

FIG. 14. Shows the MHC II binding affinity for the KGLRS (SEQ ID NO.: 1258) mimic in Zika and the TDKEK (SEQ ID NO.: 56) motif in dengue type 1

Figure 15:
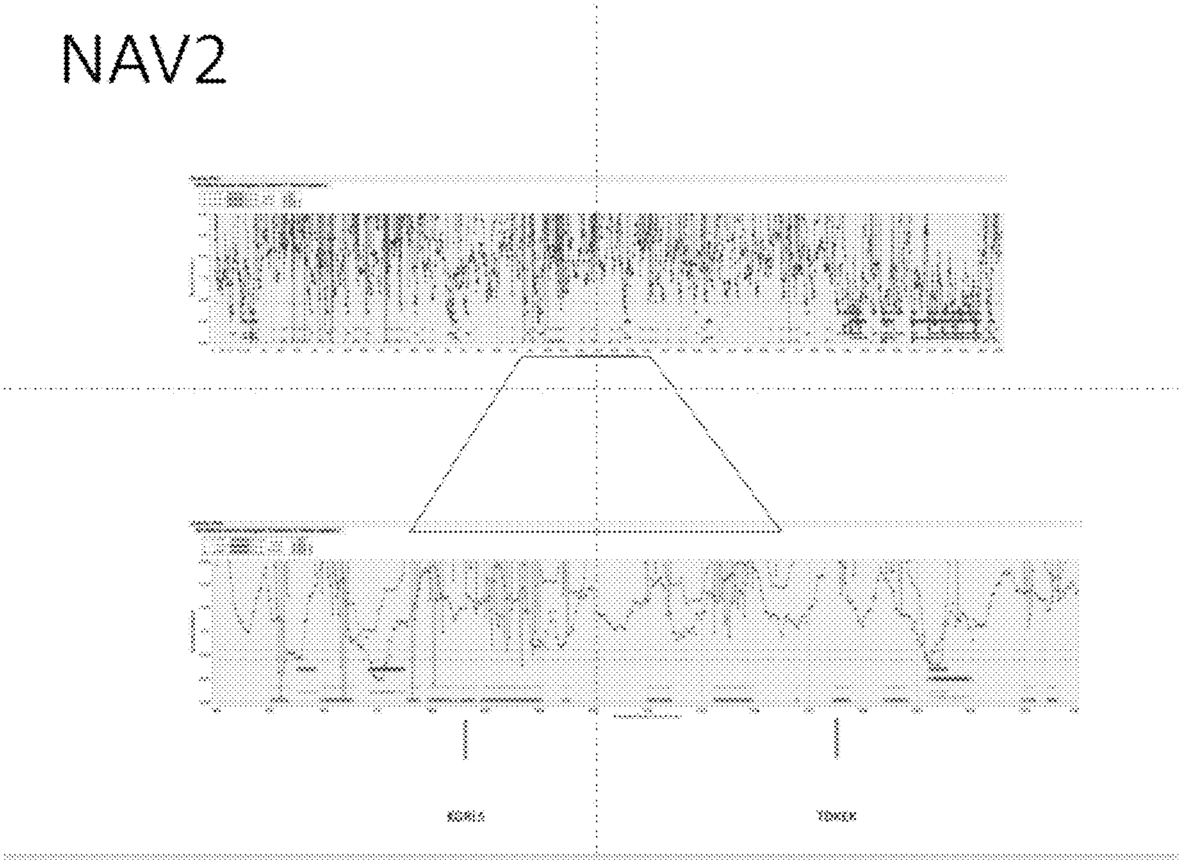

FIG. 15. Shows position of mimic peptides from Zika and dengue 1 in neural navigator 2 protein FIG. 16: Shows the layout of synthetic polypeptides of neuropeptide Y and NAV2 wherein both native wild type and scrambled epitope mimics are included. Where not otherwise indicated, the sequence is the native sequence of the underlying human protein. YF indicates a motif recognized by antibodies to yellow fever. T indicates a tag which may be a histag. TT indicates a motif from tetanus toxin.

Figure 17:
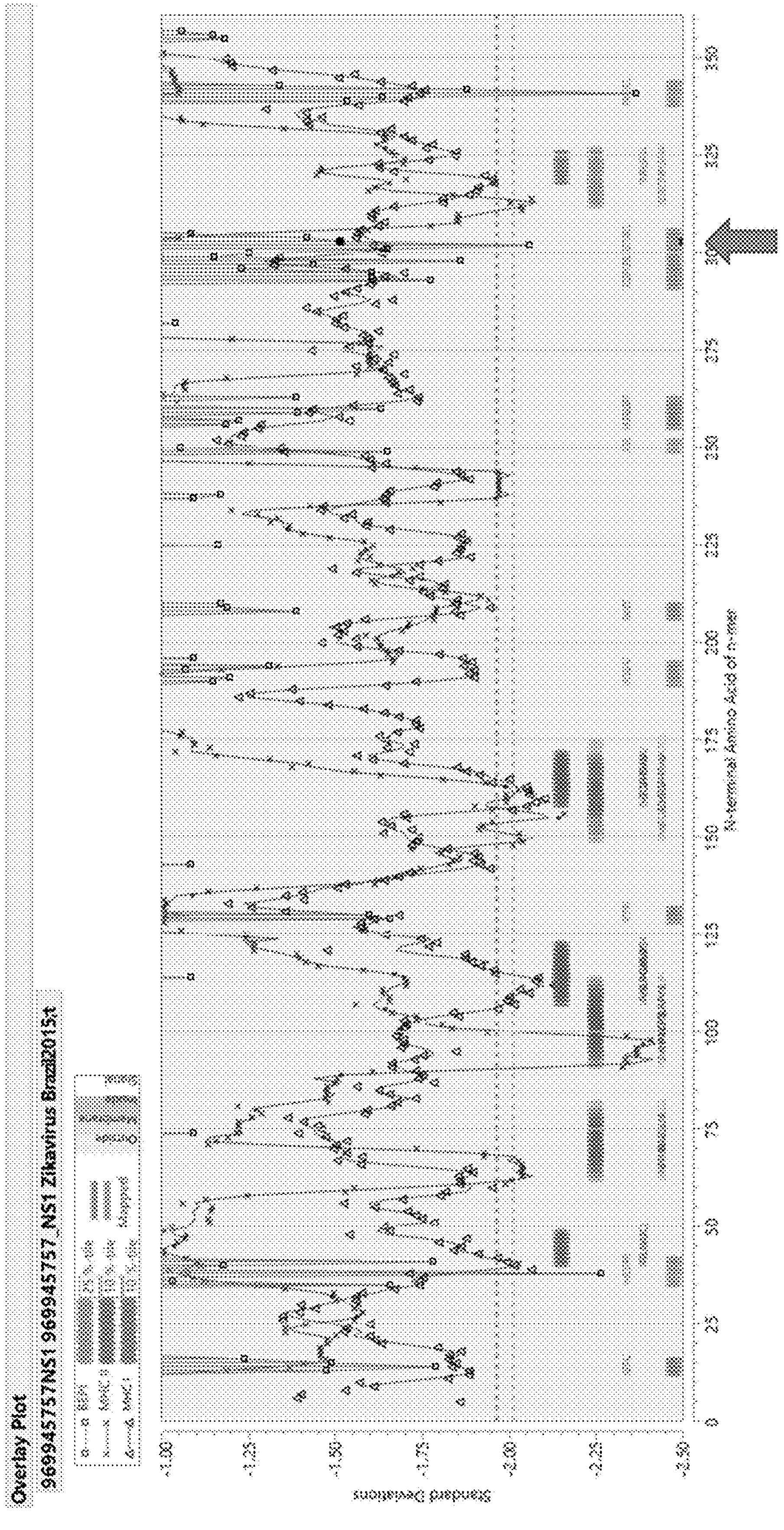

FIG. 17: Shows the location of the motif STTAS (SEQ ID NO.: 702) in the NS1 protein of Zika virus FIG. 18: Shows position of STTAS (SEQ ID NO.: 702) in Zika NS1 (large arrow) and associated MHC II binding (small arrow)

Figure 19:
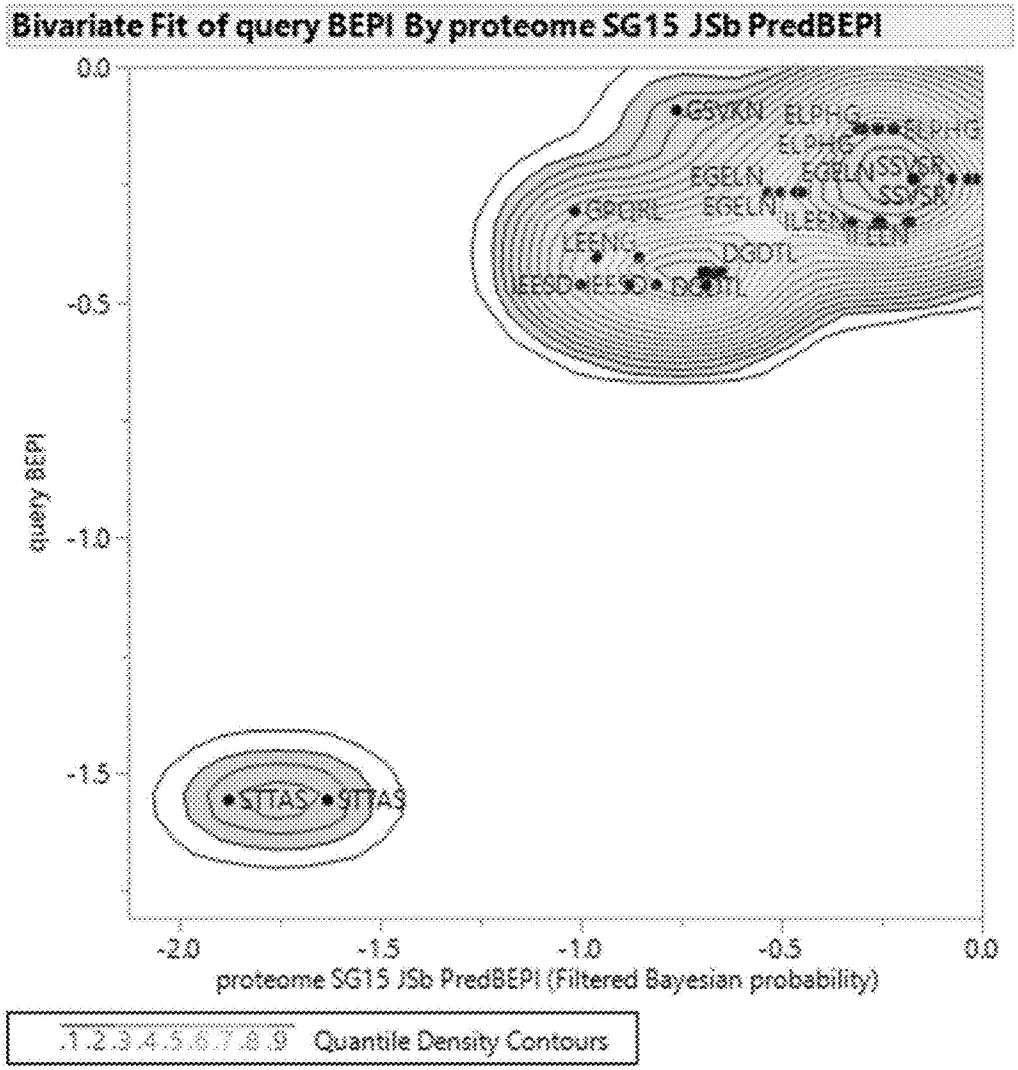

FIG. 19: Shows the identification of the motif STTAS (SEQ ID NO.: 702) as being a high probability B cell epitope in both the NS1 protein and in human ASPM. The Y axis shows probability in the NS1 protein and the X axis shows probability in ASPM. In both cases probability is shown as a negative of the standard deviation from mean probability.

Figure 20:
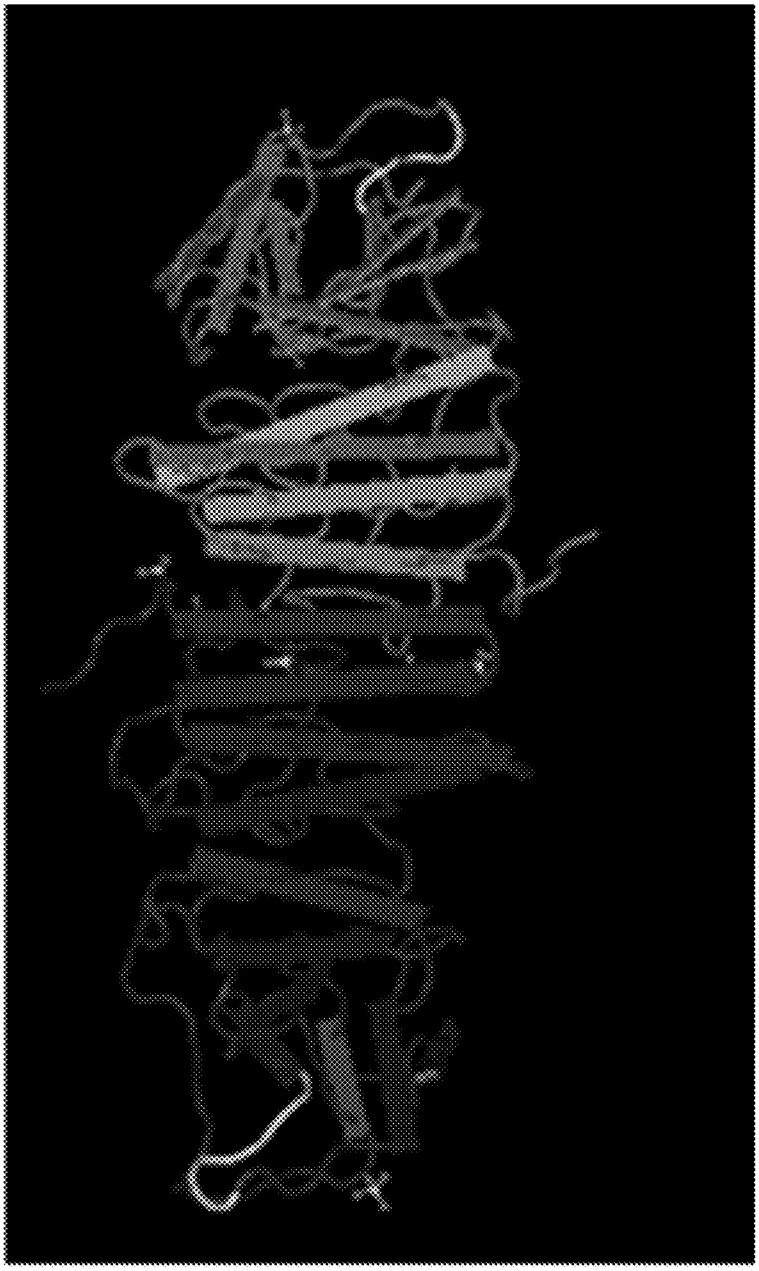

FIG. 20: NS1 dimer of dengue showing the location occupied by STTAS (SEQ ID NO.: 702) in ZIKA NS1

Figure 21:

FIG. 21: Shows the location of the STTAS (SEQ ID NO.: 702) motif in the human ASPM protein FIG. 22: Conservation and cross reactivity of selected envelope peptides within flaviviruses and chikungunya. The sequences correspond to table 16: SEQ ID NOs. 446-589 and 1247-1256.

FIG. 23: Conservation and cross reactivity of selected NS1 peptides within flaviviruses and chikungunya. The sequences correspond to table 17: SEQ ID NOs. 590-703.

FIG. 24: Cross reactivity of selected envelope peptides with other microorganisms. The sequences correspond to table 18: SEQ ID NOs. 446-589 and 1247-1256.

FIG. 25: Cross reactivity of selected NS1 peptides with other microorganisms. The sequences correspond to table 19: SEQ ID NOs. 647-703.

FIG. 26: Alignment of B cell epitopes in Zika (top) and dengue serotype 3 (bottom) with B cell epitopes in *P falciparum* and *P vivax*, in the fusion loop region of the Zika and dengue envelope protein which is the source of cross reactive antibodies, showing the absence of matching *Plasmodium* epitopes in this region at index amino acid positions ~98-100. SEQ ID NOs.: 1307-1333.

Figure 27:
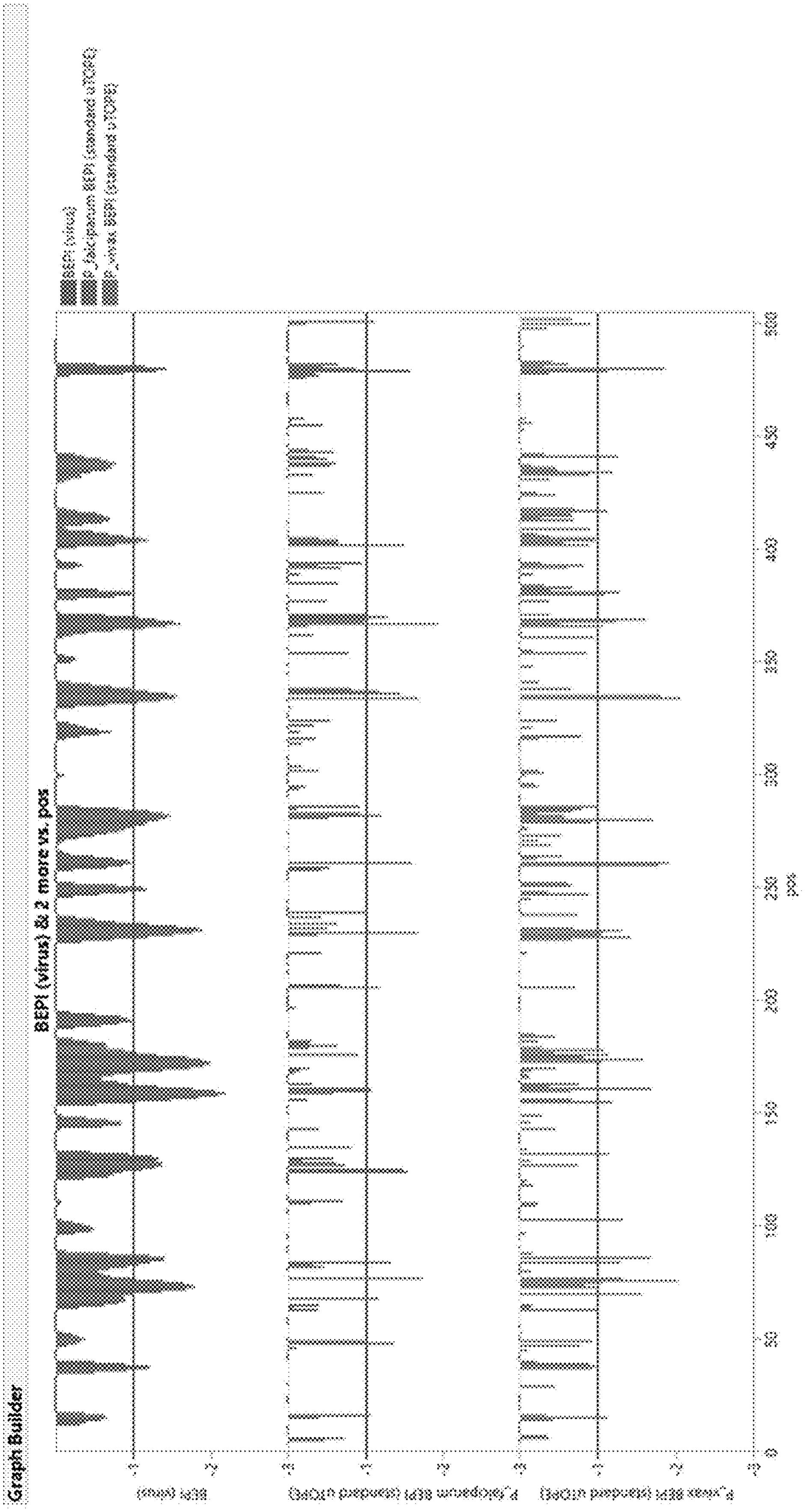

FIG. 27: High probability B cell epitopes in Zika Envelope protein (top); with matching B cell epitopes in proteins of *P. falciparum* (middle) and *P. vivax* (bottom). B cell probability of binding is shown inverted; highest probability is indicated by a downward spike.

Figure 28:
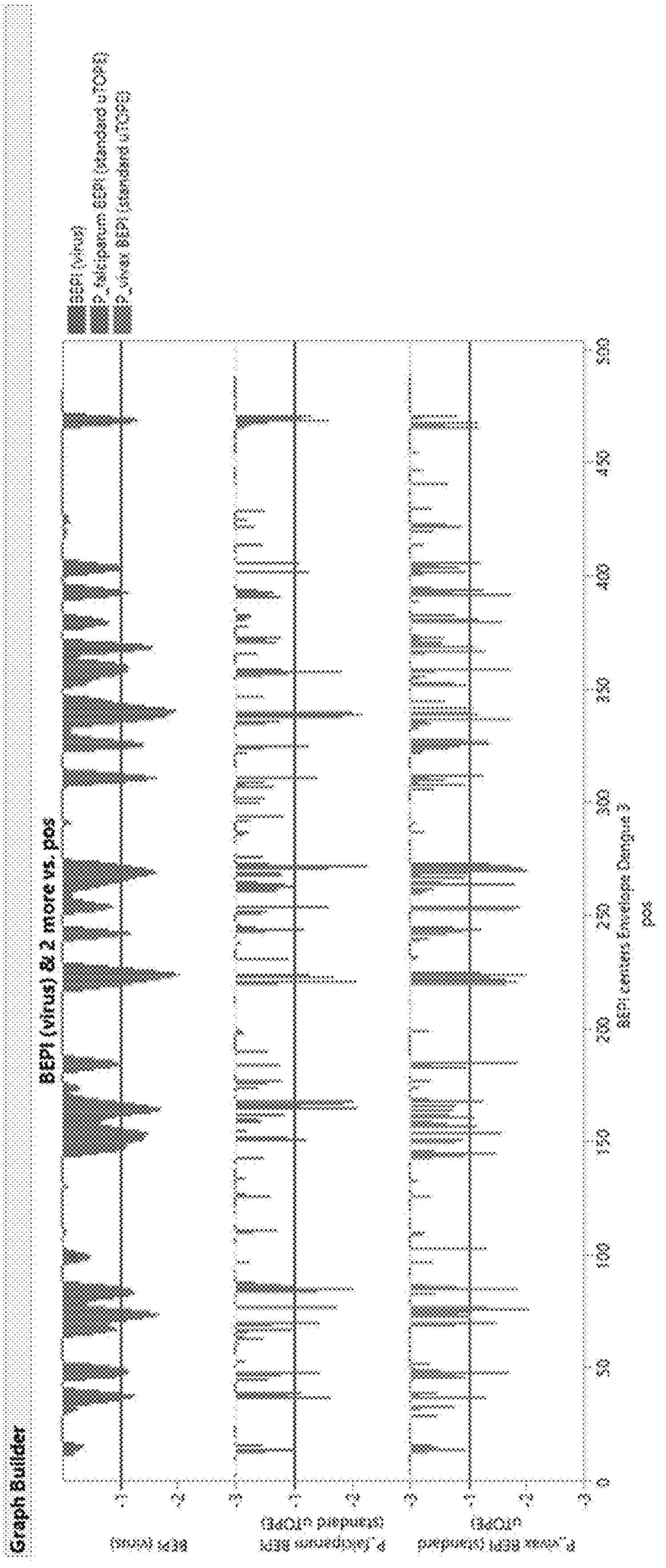

FIG. 28: High probability B cell epitopes in dengue serotype 3 Envelope protein (top); with matching B cell epitopes in proteins of *P. falciparum* (middle) and *P. vivax* (bottom). B cell probability of binding is shown inverted; highest probability is indicated by a downward spike.

Figure 29:
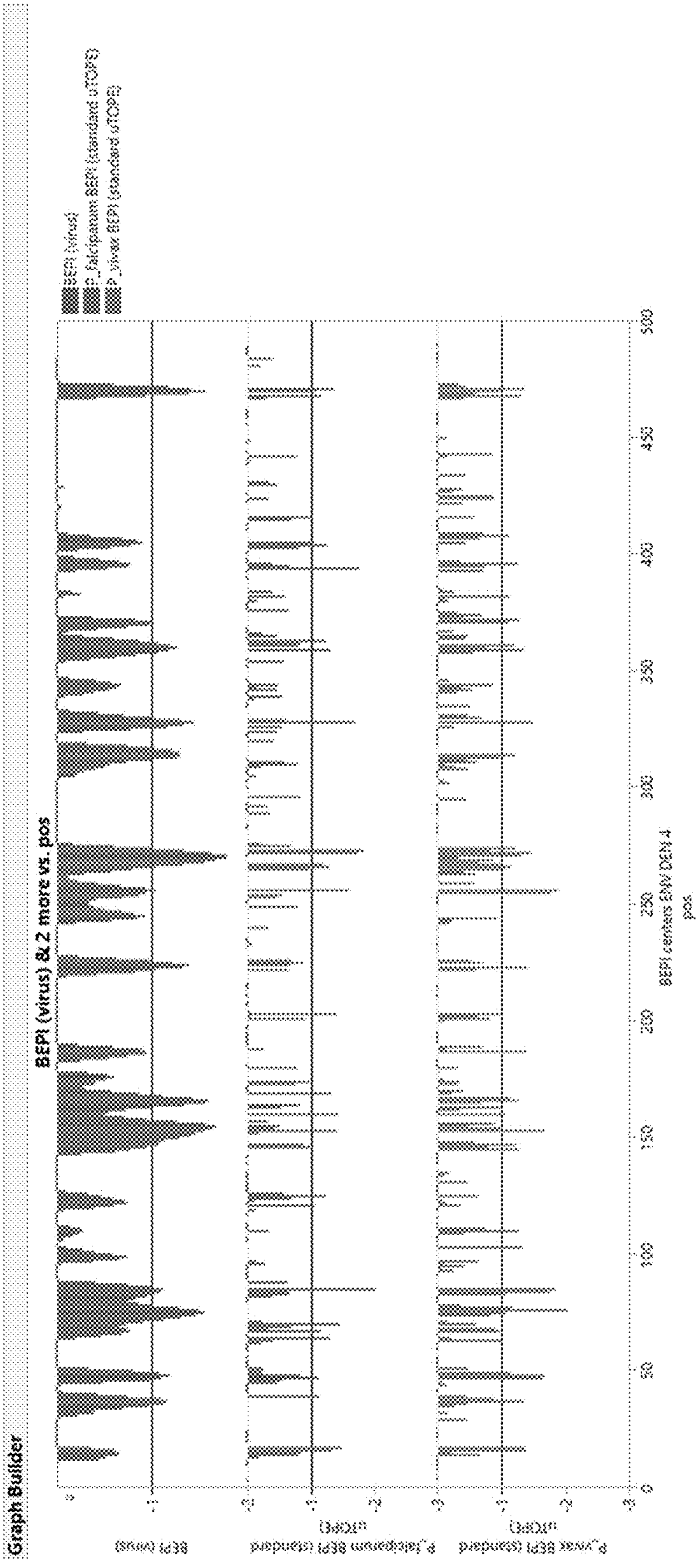

FIG. 29: High probability B cell epitopes in dengue serotype 4 Envelope protein (top); with matching B cell epitopes in proteins of *P. falciparum* (middle) and *P. vivax* (bottom). B cell probability of binding is shown inverted; highest probability is indicated by a downward spike.

Figure 30:
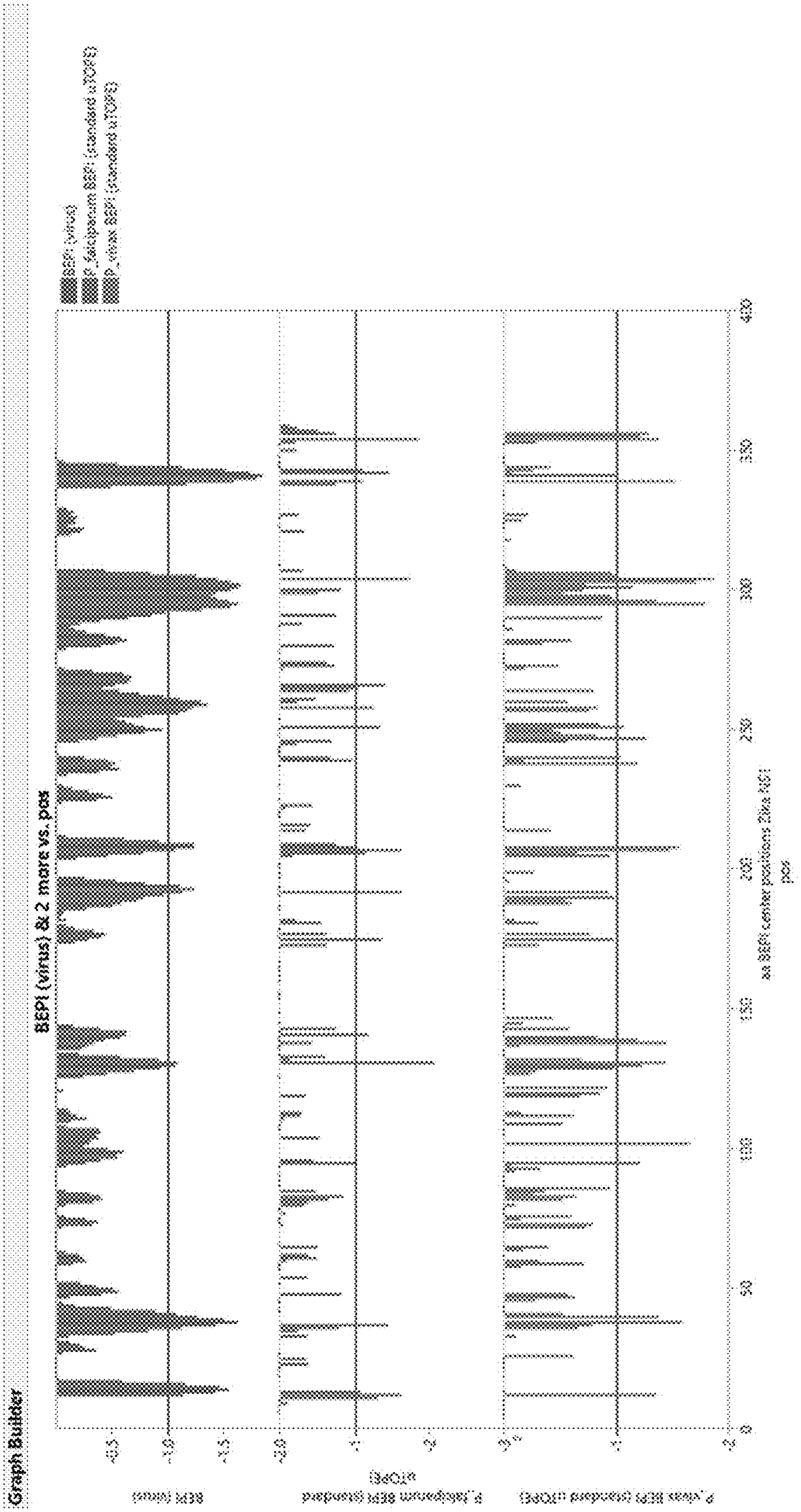

FIG. 30: High probability B cell epitopes in Zika NS1 protein (top); with matching B cell epitopes in proteins of *P. falciparum* (middle) and *P. vivax* (bottom). B cell probability of binding is shown inverted; highest probability is indicated by a downward spike.

Figure 31:
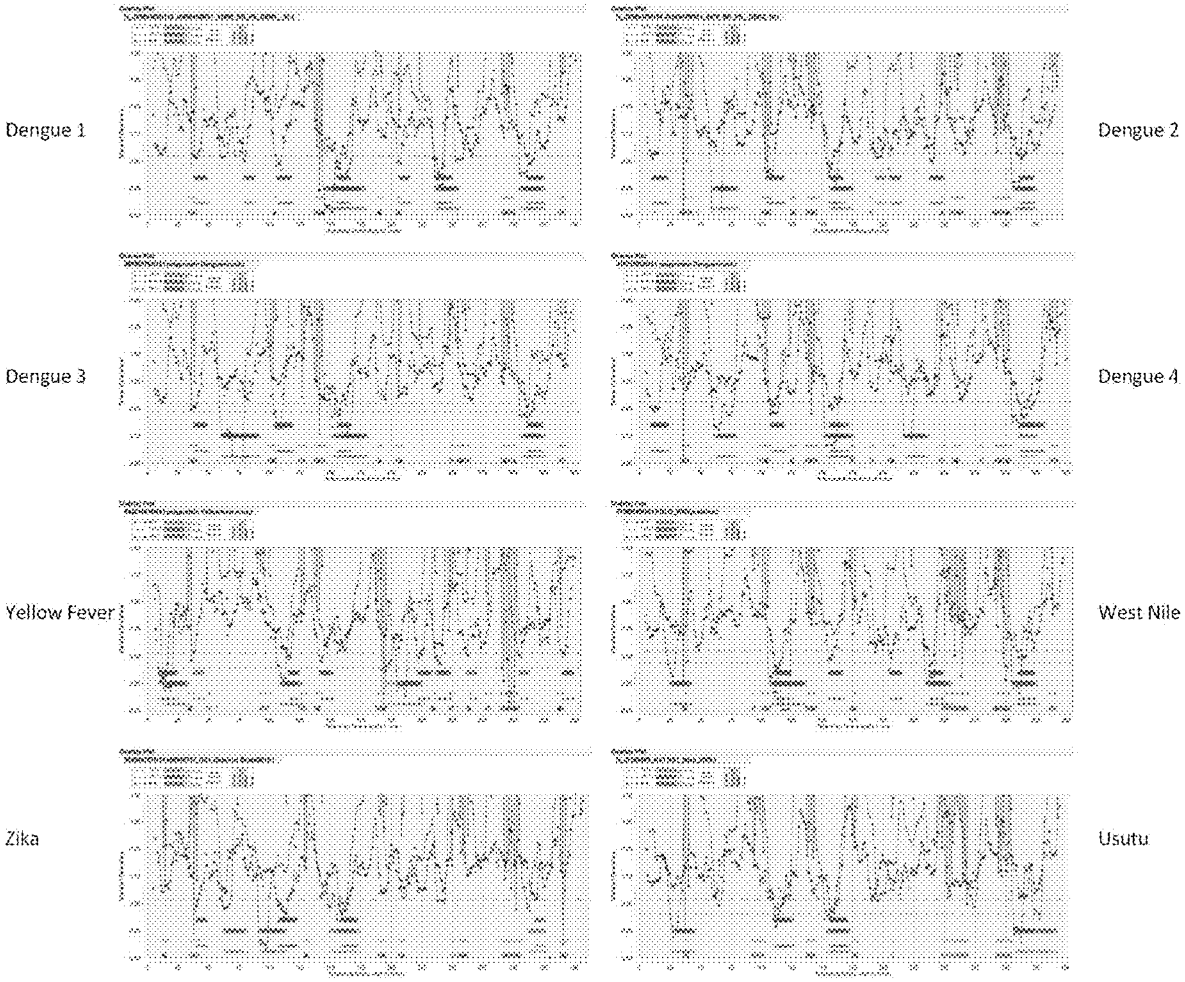

FIG. 31: Comparison of the epitope patterns of NS1 for flaviviruses of interest. A population permuted plot is shown in which predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).

Figure 32:
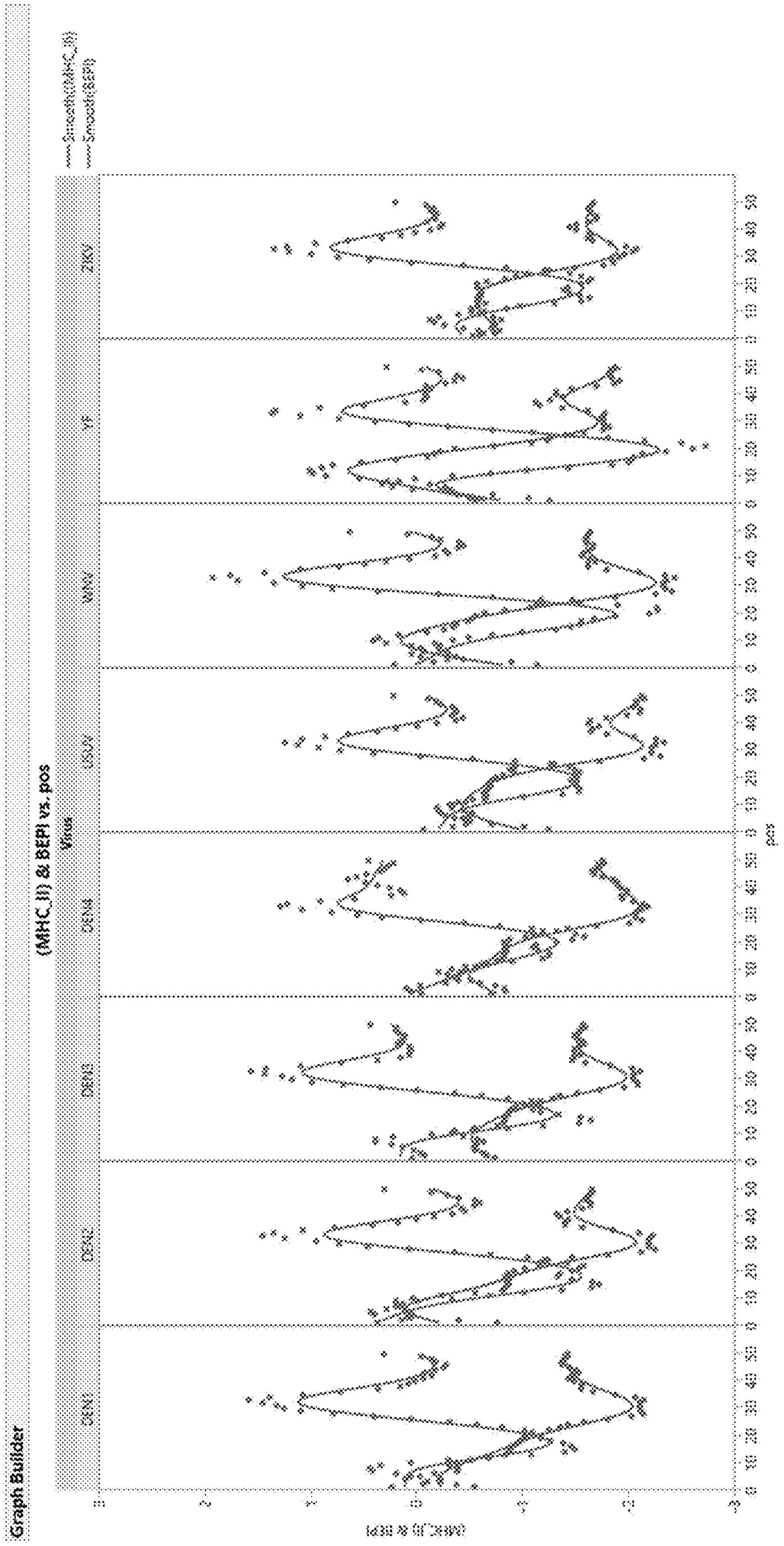

FIG. 32: Comparative MHC II predicted binding and B cell epitope probability across 50 15-mer peptides with index positions of 280-329 in multiple flavivirus NS1 proteins.

Figure 33:
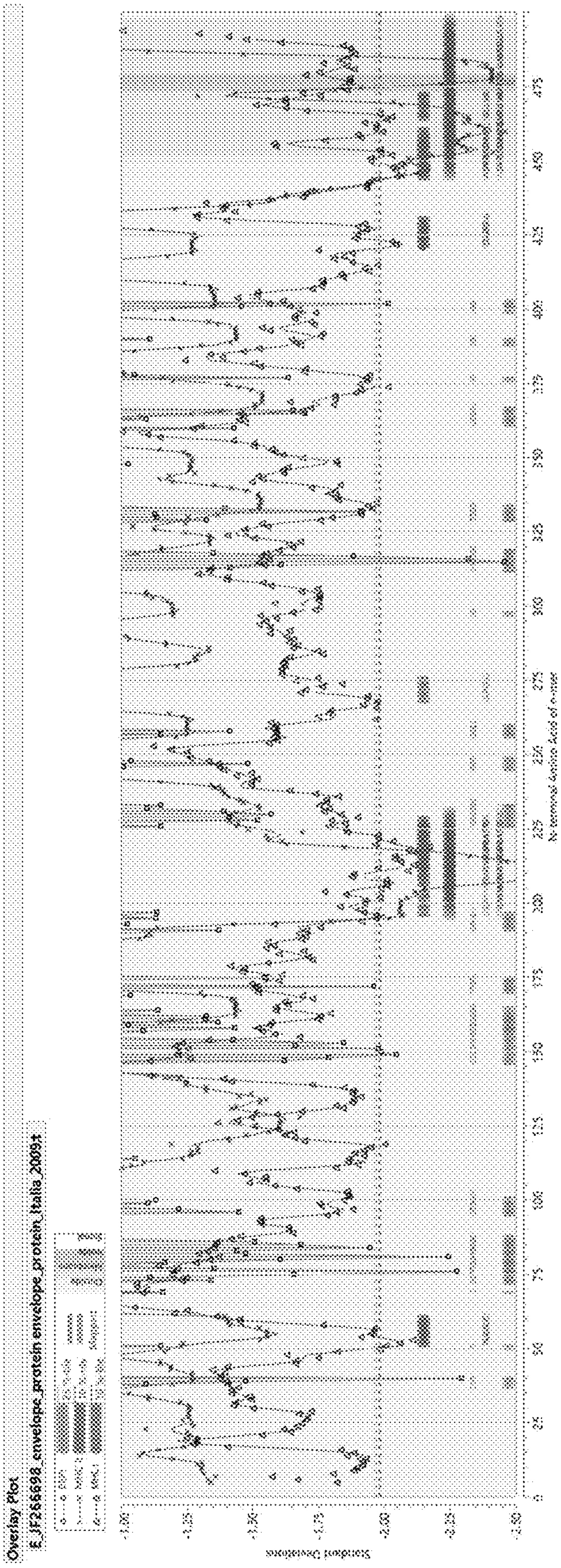

FIG. 33: Envelope protein of Usutu virus, based on recent European isolates, using the Usutu Italian isolate, Accession number JF266698. A population permuted plot is shown in which predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).

Figure 34:
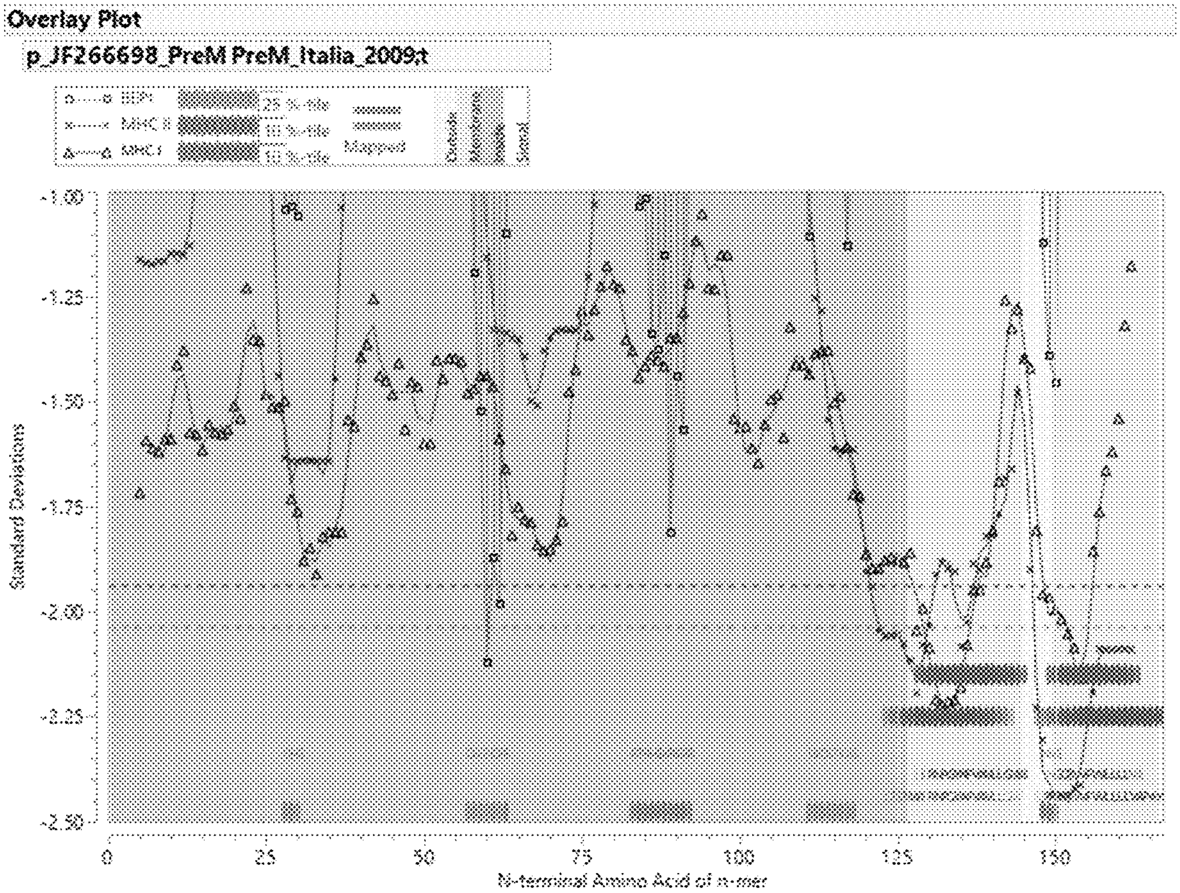

FIG. 34: PrM protein of Usutu virus, based on recent European isolates, using the Usutu Italian isolate, Accession number JF266698. A population permuted plot is shown in which predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).

Figure 35:
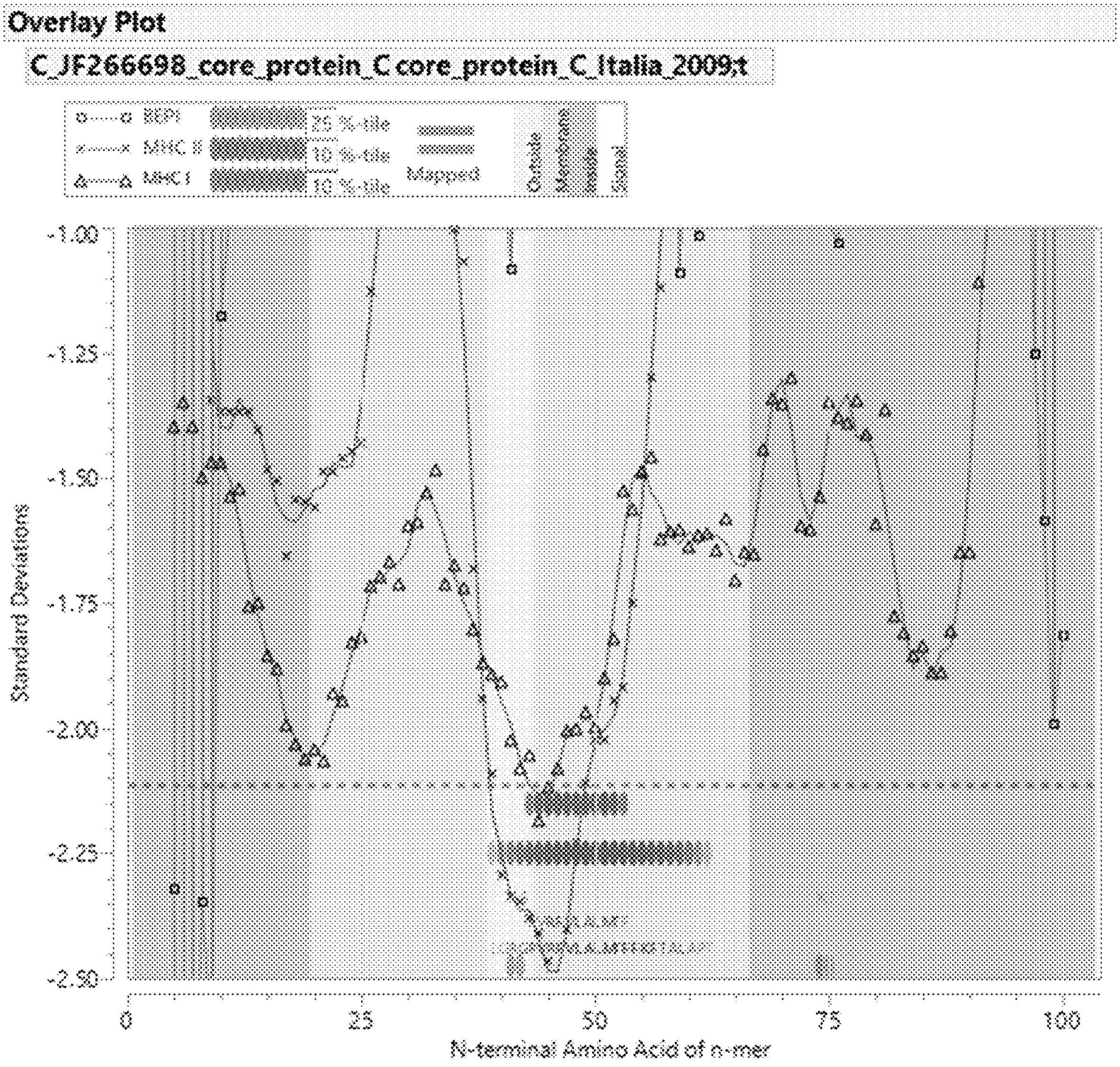

FIG. 35: Capsid protein of Usutu virus, based on recent European isolates, using the Usutu Italian isolate, Accession number JF266698. A population permuted plot is shown in which predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).

Figure 36:
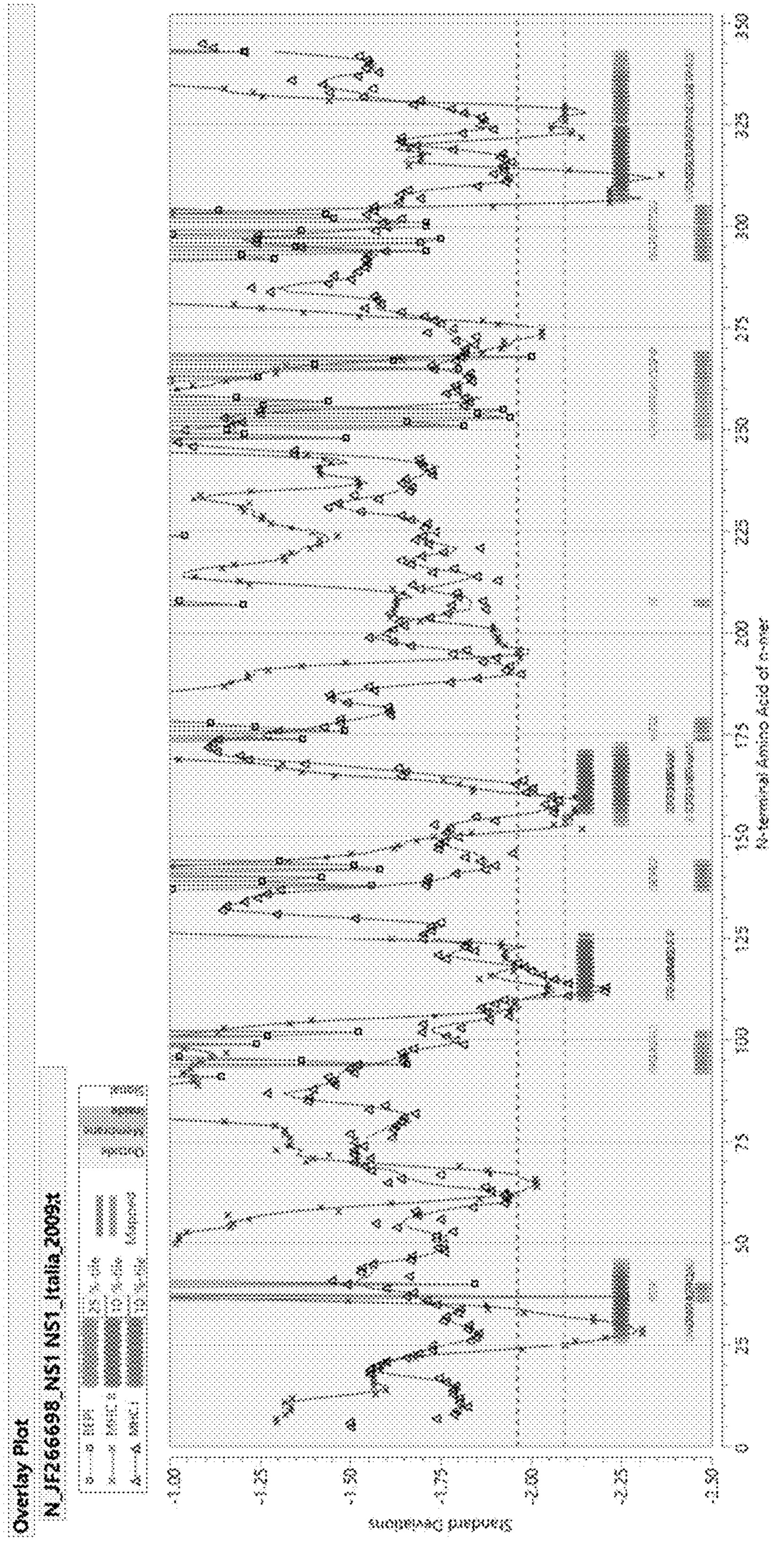

FIG. 36: NS1 protein of Usutu virus, based on recent European isolates, using the Usutu Italian isolate, Accession number JF266698. A population permuted plot is shown in which predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).

DEFINITIONS

As used herein, the term "genome" refers to the genetic material (e.g., chromosomes) of an organism or a host cell.

As used herein, the term "proteome" refers to the entire set of proteins expressed by a genome, cell, tissue or organism. A "partial proteome" refers to a subset the entire set of proteins expressed by a genome, cell, tissue or organism. Examples of "partial proteomes" include, but are not limited to, transmembrane proteins, secreted proteins, and proteins with a membrane motif. Human proteome refers to all the proteins comprised in a human being. Multiple such sets of proteins have been sequenced and are accessible at the InterPro international repository (ebi.ac.uk/interpro). Human proteome is also understood to include those proteins and antigens thereof which may be over-expressed in certain pathologies, or expressed in a different isoforms in certain pathologies. Hence, as used herein, tumor associated antigens are considered part of the human proteome.

As used herein, the terms "protein," "polypeptide," and "peptide" refer to a molecule comprising amino acids joined via peptide bonds. In general "peptide" is used to refer to a sequence of 20 or less amino acids and "polypeptide" is used to refer to a sequence of greater than 20 amino acids.

As used herein, the term, "synthetic polypeptide," "synthetic peptide" and "synthetic protein" refer to peptides, polypeptides, and proteins that are produced by a recombinant process (i.e., expression of exogenous nucleic acid encoding the peptide, polypeptide or protein in an organism, host cell, or cell-free system) or by chemical synthesis.

As used herein, the term "protein of interest" refers to a protein encoded by a nucleic acid of interest. It may be applied to any protein to which further analysis is applied or the properties of which are tested or examined. Similarly, as used herein, "target protein" may be used to describe a protein of interest that is subject to further analysis.

As used herein "peptidase" refers to an enzyme which cleaves a protein or peptide. The term peptidase may be used interchangeably with protease, proteinases, oligopeptidases, and proteolytic enzymes. Peptidases may be endopeptidases (endoproteases), or exopeptidases (exoproteases). Similarly, the term peptidase inhibitor may be used interchangeably with protease inhibitor or inhibitor of any of the other alternate terms for peptidase.

As used herein, the term "exopeptidase" refers to a peptidase that requires a free N-terminal amino group, C-terminal carboxyl group or both, and hydrolyses a bond not more than three residues from the terminus. The exopeptidases are further divided into aminopeptidases, carboxypeptidases, dipeptidyl-peptidases, peptidyl-dipeptidases, tripeptidyl-peptidases and dipeptidases.

As used herein, the term "endopeptidase" refers to a peptidase that hydrolyses internal, alpha-peptide bonds in a polypeptide chain, tending to act away from the N-terminus or C-terminus. Examples of endopeptidases are chymotrypsin, pepsin, papain and cathepsins. A very few endopeptidases act a fixed distance from one terminus of the substrate, an example being mitochondrial intermediate peptidase. Some endopeptidases act only on substrates smaller than proteins, and these are termed oligopeptidases. An example of an oligopeptidase is thimet oligopeptidase. Endopeptidases initiate the digestion of food proteins, generating new N- and C-termini that are substrates for the exopeptidases that complete the process. Endopeptidases also process proteins by limited proteolysis. Examples are the removal of signal peptides from secreted proteins (e.g. signal peptidase I) and the maturation of precursor proteins (e.g. enteropeptidase, furin). In the nomenclature of the Nomenclature Committee of the International Union of Biochemistry and Molecular Biology (NC-IUBMB) endopeptidases are allocated to sub-subclasses EC 3.4.21, EC 3.4.22, EC 3.4.23, EC 3.4.24 and EC 3.4.25 for serine-, cysteine-, aspartic-, metallo- and threonine-type endopeptidases, respectively. Endopeptidases of particular interest are the cathepsins, and especially cathepsin B, L and S known to be active in antigen presenting cells.

As used herein, the term "immunogen" refers to a molecule which stimulates a response from the adaptive immune system, which may include responses drawn from the group comprising an antibody response, a cytotoxic T cell response, a T helper response, and a T cell memory. An immunogen may stimulate an upregulation of the immune response with a resultant inflammatory response, or may result in down-regulation or immunosuppression. Thus, the T-cell response may be a T regulatory response. An immunogen also may stimulate a B-cell response and lead to an increase in antibody titer.

As used herein, the term "native" (or "wild type") when used in reference to a protein refers to proteins encoded by the genome of a cell, tissue, or organism, other than one manipulated to produce synthetic proteins.

As used herein the term "epitope" refers to a peptide sequence which elicits an immune response, from either T cells or B cells or antibody.

As used herein, the term "B-cell epitope" refers to a polypeptide sequence that is recognized and bound by a B-cell receptor. A B-cell epitope may be a linear peptide or may comprise several discontinuous sequences which together are folded to form a structural epitope. Such component sequences which together make up a B-cell epitope are referred to herein as B-cell epitope sequences. Hence, a B-cell epitope may comprise one or more B-cell epitope sequences. Hence, a B cell epitope may comprise one or more B-cell epitope sequences. A linear B-cell epitope may comprise as few as 2-4 amino acids or more amino acids.

As used herein, the term "predicted B-cell epitope" refers to a polypeptide sequence that is predicted to bind to a B-cell receptor by a computer program, for example, as described in PCT US2011/029192, PCT US2012/055038, and US2014/014523, each of which is incorporated herein by reference, and in addition by Bepipred (Larsen, et al., Immunome Research 2:2, 2006) and others as referenced by Larsen et al (ibid) (Hopp T et al PNAS 78:3824-3828, 1981; Parker J et al, Biochem. 25:5425-5432, 1986). A predicted B-cell epitope may refer to the identification of B-cell epitope sequences forming part of a structural B-cell epitope or to a complete B-cell epitope. In some usages herein B cell epitope is abbreviated to BEPI.

B cell epitopes are indicated in tables and graphics using an inverted scale in which most negative numbers are indicative of highest binding in standard deviation units. This is for convenience to allow graphics to be plotted containing MHC binding and BEPI probability.

As used herein, the term "T-cell epitope" refers to a polypeptide sequence which when bound to a major histocompatibility protein molecule provides a configuration recognized by a T-cell receptor. Typically, T-cell epitopes are presented bound to a MEW molecule on the surface of an antigen-presenting cell.

As used herein, the term "predicted T-cell epitope" refers to a polypeptide sequence that is predicted to bind to a major histocompatibility protein molecule by the neural network algorithms described herein, by other computerized methods, or as determined experimentally.

As used herein, the term "major histocompatibility complex (MHC)" refers to the MHC Class I and MEW Class II genes and the proteins encoded thereby. Molecules of the MEW bind small peptides and present them on the surface of cells for recognition by T-cell receptor-bearing T-cells. The MHC-Is both polygenic (there are several MHC class I and MEW class II genes) and polyallelic or polymorphic (there are multiple alleles of each gene). The terms MHC-I, MHC-1 and MHC-2 are variously used herein to indicate these classes of molecules. Included are both classical and nonclassical MHC molecules. An MHC molecule is made up of multiple chains (alpha and beta chains) which associate to form a molecule. The MHC molecule contains a cleft or groove which forms a binding site for peptides. Peptides bound in the cleft or groove may then be presented to T-cell receptors. The term "MHC binding region" refers to the groove region of the MEW molecule where peptide binding occurs.

As used herein, a "MHC II binding groove" refers to the structure of an MEW molecule that binds to a peptide. The peptide that binds to the MEW II binding groove may be from about 11 amino acids to about 23 amino acids in length, but typically comprises a 15-mer. The amino acid positions in the peptide that binds to the groove are numbered based on a central core of 9 amino acids numbered 1-9, and positions outside the 9 amino acid core numbered as negative (N terminal) or positive (C terminal). Hence, in a 15mer the amino acid binding positions are numbered from −3 to +3 or as follows: −3, −2, −1, 1, 2, 3, 4, 5, 6, 7, 8, 9, +1, +2, +3.

As used herein, the term "polypeptide sequence that binds to at least one major histocompatibility complex (MHC) binding region" refers to a polypeptide sequence that is recognized and bound by one or more particular MHC binding regions as predicted by the neural network algorithms described herein or as determined experimentally.

As used herein, the term "affinity" refers to a measure of the strength of binding between two members of a binding pair, for example, an antibody and an epitope and an epitope and a MHC-I or II haplotype. $K_d$ is the dissociation constant and has units of molarity. The affinity constant is the inverse of the dissociation constant. An affinity constant is sometimes used as a generic term to describe this chemical entity. It is a direct measure of the energy of binding. The natural logarithm of K is linearly related to the Gibbs free energy of binding through the equation $\Delta G_0 = -RT\,LN(K)$ where R=gas constant and temperature is in degrees Kelvin. Affinity may be determined experimentally, for example by surface plasmon resonance (SPR) using commercially available Biacore SPR units (GE Healthcare) or in silico by methods such as those described herein in detail. Affinity may also be expressed as the ic50 or inhibitory concentration 50, that concentration at which 50% of the peptide is displaced. Likewise ln(ic50) refers to the natural log of the ic50.

The term "$K_{off}$", as used herein, is intended to refer to the off rate constant, for example, for dissociation of an antibody from the antibody/antigen complex, or for dissociation of an epitope from an MHC haplotype.

The term "$K_d$", as used herein, is intended to refer to the dissociation constant (the reciprocal of the affinity constant "Ka"), for example, for a particular antibody-antigen interaction or interaction between an epitope and an MHC haplotype.

As used herein, the terms "strong binder" and "strong binding" and "High binder" and "high binding" or "high affinity" refer to a binding pair or describe a binding pair that have an affinity of greater than $2\times10^7 M^{-1}$ (equivalent to a dissociation constant of 50 nM Kd)

As used herein, the term "moderate binder" and "moderate binding" and "moderate affinity" refer to a binding pair or describe a binding pair that have an affinity of from $2\times10^7 M^{-1}$ to $2\times10^6 M^{-1}$.

As used herein, the terms "weak binder" and "weak binding" and "low affinity" refer to a binding pair or describe a binding pair that have an affinity of less than $2\times10^6 M^{-1}$ (equivalent to a dissociation constant of 500 nM Kd)

Binding affinity may also be expressed by the standard deviation from the mean binding found in the peptides making up a protein. Hence a binding affinity may be expressed as "$-1\sigma$" or $<-1\sigma$, where this refers to a binding affinity of 1 or more standard deviations below the mean. A common mathematical transformation used in statistical analysis is a process called standardization wherein the distribution is transformed from its standard units to standard deviation units where the distribution has a mean of zero and a variance (and standard deviation) of 1. Because each protein comprises unique distributions for the different MHC alleles standardization of the affinity data to zero mean and unit variance provides a numerical scale where different alleles and different proteins can be compared. Analysis of a wide range of experimental results suggest that a criterion of standard deviation units can be used to discriminate between potential immunological responses and non-responses. An affinity of 1 standard deviation below the mean was found to be a useful threshold in this regard and thus approximately 15% (16.2% to be exact) of the peptides found in any protein will fall into this category.

The terms "specific binding" or "specifically binding" when used in reference to the interaction of an antibody and a protein or peptide or an epitope and an MHC haplotype means that the interaction is dependent upon the presence of a particular structure (i.e., the antigenic determinant or epitope) on the protein; in other words, the antibody is recognizing and binding to a specific protein structure rather than to proteins in general. For example, if an antibody is specific for epitope "A," the presence of a protein containing epitope A (or free, unlabeled A) in a reaction containing labeled "A" and the antibody will reduce the amount of labeled A bound to the antibody.

As used herein, the term "antigen binding protein" refers to proteins that bind to a specific antigen. "Antigen binding proteins" include, but are not limited to, immunoglobulins, including polyclonal, monoclonal, chimeric, single chain, and humanized antibodies, Fab fragments, F(ab')2 fragments, and Fab expression libraries. Various procedures known in the art are used for the production of polyclonal antibodies. For the production of antibody, various host animals can be immunized by injection with the peptide corresponding to the desired epitope including but not limited to rabbits, mice, rats, sheep, goats, etc. Various adjuvants are used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (Bacille Calmette-Guerin) and *Corynebacterium parvum*.

For preparation of monoclonal antibodies, any technique that provides for the production of antibody molecules by continuous cell lines in culture may be used (See e.g., Harlow and Lane, Antibodies: A Laboratory Manual, Cold Spring Harbor Laboratory Press, Cold Spring Harbor, N.Y.). These include, but are not limited to, the hybridoma technique originally developed by Köhler and Milstein (Köhler and Milstein, Nature, 256:495-497 [1975]), as well as the trioma technique, the human B-cell hybridoma technique (See e.g., Kozbor et al., Immunol. Today, 4:72 [1983]), and the EBV-hybridoma technique to produce human monoclonal antibodies (Cole et al., in Monoclonal Antibodies and Cancer Therapy, Alan R. Liss, Inc., pp. 77-96 [1985]). In other embodiments, suitable monoclonal antibodies, including recombinant chimeric monoclonal antibodies and chimeric monoclonal antibody fusion proteins are prepared as described herein.

According to the invention, techniques described for the production of single chain antibodies (U.S. Pat. No. 4,946,778; herein incorporated by reference) can be adapted to produce specific single chain antibodies as desired. An additional embodiment of the invention utilizes the techniques known in the art for the construction of Fab expression libraries (Huse et al., Science, 246:1275-1281 [1989]) to allow rapid and easy identification of monoclonal Fab fragments with the desired specificity.

Antibody fragments that contain the idiotype (antigen binding region) of the antibody molecule can be generated by known techniques. For example, such fragments include but are not limited to: the F(ab')2 fragment that can be produced by pepsin digestion of an antibody molecule; the Fab' fragments that can be generated by reducing the disulfide bridges of an F(ab')2 fragment, and the Fab fragments that can be generated by treating an antibody molecule with papain and a reducing agent.

Genes encoding antigen-binding proteins can be isolated by methods known in the art. In the production of antibodies, screening for the desired antibody can be accomplished by techniques known in the art (e.g., radioimmunoassay, ELISA (enzyme-linked immunosorbant assay), "sandwich" immunoassays, immunoradiometric assays, gel diffusion precipitin reactions, immunodiffusion assays, in situ immunoassays (using colloidal gold, enzyme or radioisotope labels, for example), Western Blots, precipitation reactions, agglutination assays (e.g., gel agglutination assays, hemagglutination assays, etc.), complement fixation assays, immunofluorescence assays, protein A assays, and immunoelectrophoresis assays, etc.) etc.

As used herein "immunoglobulin" means the distinct antibody molecule secreted by a clonal line of B cells; hence when the term "100 immunoglobulins" is used it conveys the distinct products of 100 different B-cell clones and their lineages.

As used herein, the term "vector," when used in relation to recombinant DNA technology, refers to any genetic element, such as a plasmid, phage, transposon, cosmid, chromosome, retrovirus, virion, etc., which is capable of replication when associated with the proper control elements and which can transfer gene sequences between cells. Thus, the term includes cloning and expression vehicles, as well as viral vectors.

As used herein, the term "vector" when used in relation to transmission of an arbovirus refers to the intermediate host of a virus, such as a mosquito or tick or other arthropod.

As used herein, the term "host cell" refers to any eukaryotic cell (e.g., mammalian cells, avian cells, amphibian cells, plant cells, fish cells, insect cells, yeast cells), and bacteria cells, and the like, whether located in vitro or in vivo (e.g., in a transgenic organism).

As used herein, the term "cell culture" refers to any in vitro culture of cells. Included within this term are continuous cell lines (e.g., with an immortal phenotype), primary cell cultures, finite cell lines (e.g., non-transformed cells), and any other cell population maintained in vitro, including oocytes and embryos.

The term "isolated" when used in relation to a nucleic acid, as in "an isolated oligonucleotide" refers to a nucleic acid sequence that is identified and separated from at least one contaminant nucleic acid with which it is ordinarily associated in its natural source. Isolated nucleic acids are nucleic acids present in a form or setting that is different from that in which they are found in nature. In contrast, non-isolated nucleic acids are nucleic acids such as DNA and RNA that are found in the state in which they exist in nature.

The terms "in operable combination," "in operable order," and "operably linked" as used herein refer to the linkage of nucleic acid sequences in such a manner that a nucleic acid molecule capable of directing the transcription of a given gene and/or the synthesis of a desired protein molecule is produced. The term also refers to the linkage of amino acid sequences in such a manner so that a functional protein is produced.

A "subject" is an animal such as vertebrate, preferably a mammal such as a human, or a bird, or a fish. Mammals are understood to include, but are not limited to, murines, simians, humans, bovines, ovines, cervids, equines, porcines, canines, felines etc.).

An "effective amount" is an amount sufficient to effect beneficial or desired results. An effective amount can be administered in one or more administrations, As used herein, the term "purified" or "to purify" refers to the removal of undesired components from a sample. As used herein, the term "substantially purified" refers to molecules, either nucleic or amino acid sequences, that are removed from their natural environment, isolated or separated, and are at least 60% free, preferably 75% free, and most preferably 90% free from other components with which they are naturally associated. An "isolated polynucleotide" is therefore a substantially purified polynucleotide.

"Strain" as used herein in reference to a microorganism describes an isolate of a microorganism (e.g., bacteria, virus, fungus, parasite) considered to be of the same species but with a unique genome and, if nucleotide changes are non-synonymous, a unique proteome differing from other strains of the same organism. Typically strains may be the result of isolation from a different host or at a different location and time but multiple strains of the same organism may be isolated from the same host.

"Affinity maturation" is the molecular evolution that occurs during somatic hypermutation during which unique variable region sequences generated that are the best at targeting and neutralizing and antigen become clonally expanded and dominate the responding cell populations.

"uTOPE™ analysis" as used herein refers to the computer assisted processes for predicting binding of peptides to MHC and predicting cathepsin cleavage, described in PCT US2011/029192, PCT US2012/055038, and US2014/01452, each of which is incorporated herein by reference.

"Isoform" as used herein refers to different forms of a protein which differ in a small number of amino acids. The isoform may be a full length protein (i.e., by reference to a reference wild-type protein or isoform) or a modified form of a partial protein, i.e., be shorter in length than a reference wild-type protein or isoform.

"Immunostimulation" as used herein refers to the signaling that leads to activation of an immune response, whether said immune response is characterized by a recruitment of cells or the release of cytokines which lead to suppression of the immune response. Thus immunostimulation refers to both upregulation or down regulation.

"Up-regulation" as used herein refers to an immunostimulation which leads to cytokine release and cell recruitment tending to eliminate a non-self or exogenous epitope. Such responses include recruitment of T cells, including effectors such as cytotoxic T cells, and inflammation. In an adverse reaction upregulation may be directed to a self-epitope.

"Down regulation" as used herein refers to an immunostimulation which leads to cytokine release that tends to dampen or eliminate a cell response. In some instances such elimination may include apoptosis of the responding T cells.

"IGHV" as used herein is an abbreviation for immunoglobulin heavy chain variable regions "IGLV" as used herein is an abbreviation for immunoglobulin light chain variable regions "Adverse immune response" as used herein may refer to (a) the induction of immunosuppression when the appropriate response is an active immune response to eliminate a pathogen or tumor or (b) the induction of an upregulated active immune response to a self-antigen or (c) an excessive up-regulation unbalanced by any suppression, as may occur for instance in an allergic response.

As used herein "epitope mimic" describes a peptide that is present and elicits an immune response in one protein (e.g., source protein) and the humoral and cellular effectors of that immune response then recognize and act upon the same peptide motif where it occurs in a different protein (e.g., target protein). For example, an antibody which is elicited by a B cell epitope in a microorganism and which binds to a B cell epitope peptide derived from a human protein would be said to have found an epitope mimic. Epitope mimics are those peptide motifs which have a high probability of being a B cell epitope both in the protein which elicits the antibody response and in the target protein to which said antibody binds. Peptides forming such B cell epitope mimics are typically in the top 25% of probability of being B cell epitopes within the protein. In some embodiments, epitope mimics are an important mechanism in autoimmunity. An "epitope mimic motif" as used herein is the amino acid motif comprising an epitope mimic. In some preferred cases the epitope mimic motif is a pentamer. An "epitope mimic sequence" as used herein is a nucleotide or amino acid sequence which comprises an epitope mimic.

As used herein "TCEM mimic" is used to describe a peptide which has an identical or overlapping TCEM, but may have a different GEM. Such a mimic occurring in one protein may induce an immune response directed towards another protein which carries the same TCEM motif. This may give rise to autoimmunity or inappropriate responses to the second protein.

"Anchor peptide", as used herein, refers to peptides or polypeptides which allow binding to a substrate to facilitate purification or which facilitate attachment to a solid medium such as a bead or plastic dish or are capable of insertion into a membrane of a cell or liposome or virus like particle or other nanoparticle. Among the examples of anchor peptides are the following, which are considered non-limiting, his tags, immunoglobulins, Fc region of immunoglobulin, G coupled protein, receptor ligand, biotin, and FLAG tags. In some instances, an anchor peptide is designed to be cleavable following exposure to an endopeptidase in vitro or in vivo.

"Label peptide" as used herein refers to a peptide or polypeptide which provides, either directly or by a ligated residue, a colorimetric, fluorescent, radiation emitting, light emitting, metallic or radiopaque signal which can be used to identify the location of said peptide. Among the non-limiting examples of such label peptides are streptavidin, fluorescein, luciferase, gold, ferritin, tritium, "MHC subunit chain" as used herein refers to the alpha and beta subunits of MHC molecules. A MHC II molecule is made up of an alpha chain which is constant among each of the DR, DP, and DQ variants and a beta chain which varies by allele. The MHC I molecule is made up of a constant beta macroglobulin and a variable MHC A, B or C chain.

As used herein an "immunostimulant" may refer to an adjuvant, including but not limited to Freunds adjuvant, inorganic compounds (e.g., alum, aluminum hydroxide, aluminum phosphate, calcium phosphate hydroxide), mineral oil (e.g., paraffin oil), bacterial products (e.g., killed bacteria, *Bordetella pertussis, Mycobacterium bovis*, toxoids), non-bacterial organics (e.g., squalene, thimerosal), detergents (e.g., Quil A), plant saponins from quillaja, soybean, polygala senega, cytokines (e.g., IL-1, IL-2, IL-12), and food Based oil (e.g., adjuvant 65).

A used herein the term "domain", when used herein to describe the domains of flavivirus envelopes, refers to structural domains as characterized in crystal structures (e.g., crystal structures for tick borne encephalitis and Japanese encephalitis viruses [11, 12]).

"Neural and neurologic proteins," as used herein, refers to proteins within the human proteome, which have been identified as having a function in the nervous system in development or function. Included among such proteins, but not limited to these examples, are those which have the term neural, neuron, neuronal, neurologic, neurotropic, neurotropin, neuropeptide, neurogenic, glial, synaptic, and neurite in their curation at Uniprot (uniprot.org). Proteins are described by their Uniprot identifies in the tables included herein. Glycoprotein M6A and Glial fibrillary acidic protein are also included herein. While described by use of the identifiers for human proteins the defined term is intended to also include close homologues from other species. In some embodiments, such proteins are those identified in a key word search of the complete Human proteome Uniprot curation by search for the terms "neur", "synapt" and "glial" contained in their names. As used herein the term neural and neurologic proteins refers not only to mature processed forms of the proteins but also to precursor forms of said proteins, including but not limited to propeptide and prepropeptide forms.

"Microencephaly" and "microcephaly" as used herein describes a condition of fetuses and neonates in which part or all of the brain is absent and the cranium is reduced in size at birth.

"Guillain Barré syndrome," abbreviated as GBS, as used herein refers to a complex of symptoms, which include peripheral neuropathy affecting motor, sensitive and autonomic nerves and spinal roots causing acute, or subacute, progressive motor weakness sometimes advancing to respiratory paralysis. GBS is an autoimmune disease and has been noted following various infections, including influenza, *Campylobacter*, dengue and Zika virus. Although symptomatology is shared, GBS may have various pathogeneses, with different immune responses directed to different self proteins.

"Flaviviruses" as used herein refers to the taxonomic group of viruses of that name [4]. Abbreviations are used for several flaviviruses including but not limited to Japanese encephalitis JEV or JAEV, West Nile Virus WNV, Tick Borne encephalitis TBEV, yellow fever YF, dengue DEN, Saint Louis encephalitis virus, SLE, hepatitis C HEPC, Usutu USUV, and Zika virus ZIKV "Microbiocide" as used herein refers to a composition which may be a peptide, polypeptide or enzyme or small molecule which acts on a microorganism to inhibit its replication or cause lethal structural damage. Microbiocides include but are not limited to bactericides, virucides, and fungicides.

"Cytotoxin" or "cytocide" as used herein refers to a peptide or polypeptide which is toxic to cells and which causes cell death. Among the non-limiting examples of such polypeptides are RNAses, phospholipase, membrane active peptides such as cercropin, and diphtheria toxin. Cytotoxin also includes radionuclides which are cytotoxic such as alpha emitters or Auger particles.

"Cytokine" as used herein refers to a protein which is active in cell signaling and may include, among other examples, chemokines, interferons, interleukins, lymphokines, granulocyte colony-stimulating factor tumor necrosis factor and programmed death proteins.

As used herein the term "Alpha emitter" refers to a radioisotope which emits alpha radiation. Examples of alpha emitters which may be suitable for clinical use include, but are not limited to, Astatine-211, Bismuth-212, Bismuth-213, Actinium-225 Radium-223, Terbium-149, Fermium-255

As used herein "Auger particles" refers to the low energy electrons emitted by radionuclides such as but not limited to, Gadolinium-67, Technicium-99, Indium-111, Iodine-123, Iodine-125, Tellurium-201. Auger electrons are advantageous as they have a short path of transit through tissue.

As used herein a "scrambled peptide" or "scrambled mimic" refers to a peptide in which the amino acids have been exchanged in positions. Thus, ACDEF is an example of a scrambled peptide of FDCEA. A "scrambled peptide" or "scrambled mimic" also refers to a peptide in which an epitope mimic has been removed by substituting one or more amino acids.

As used herein the term "Zika fetal syndrome" refers to one or more abnormalities in a fetus borne by a mother infected by Zika virus, or in a child resulting from such a pregnancy. Zika fetal syndrome includes, but is not limited to, spontaneous abortion, fetal death, fetal growth retardation, amniotic insufficiency, microcephaly, optical lesions, and neurologic defects detected post partum.

As used herein the term "Neuropeptide Y" is used to refer to the full proneuropeptide of 69 amino acids as well as to the mature neuropeptide Y of 36 amino acids. Human neuropeptide Y is encoded as a prepropeptide comprising a signal peptide of 28 amino acids, a neuropeptide Y mature peptide of 36 amino acids, a 3 amino acid linker and a 30 amino acid carboxyterminal flanking peptide (CPON)[5]. In some embodiments, an epitope mimic for Zika is identified in the CPON component and for dengue 3 in the mature NPY component. In some embodiments the 3 amino acid cleavage sequence glycine-lysine-arginine is mutated to prevent cleavage and retain the full length 69 amino acid propeptide.

As used herein "microcephaly associated protein" refers to a protein which contains the term microcephaly in the UniProt description of its functions or pathological associations. Microcephaly associated proteins include but are not limited to proteins encoded by the following genes: MCPH1, Microcephalin, MCPH2, WDR62, MCPH3, CDK5RAP2, MCPH4, CASC5, MCPH5, ASPM, MCPH6, CENPJ, MCPH7, STIL, MCPH8, CEP135, MCPH9, CEP152, MCPH10, ZNF335, MCPH11, PHC1, MCPH12, and CDK6.

"Abnormal spindle like microcephaly associated protein" also known as "abnormal spindle like primary microcephaly protein" or "ASPM" refers to the protein designated as Uniprot Q8IZT6, and identified as having a role in mitotic spindle regulation.

As used herein the proteins comprising the polyprotein of Zika virus may be abbreviated as follows Capsid as "caps" or "C", Propeptide membrane as "PrM", envelope as "Env" or "E" and the nonstructural proteins as NS1, NS2A, NS2B, NS3, NS4A, NS4B, and NS5.

As used herein the term "pan flavivirus epitope" and "pan flavivirus antibody" refer to epitopes, and antibodies that are directed to them, which cross react between the serotypes of dengue, Zika and Yellow fever, and in some cases with other flaviviruses. These include but are not limited to epitopes located in the envelope protein fusion loop, in the region comprising amino acids DRGWGN.

As used herein the term "Antibody dependent enhancement" or "ADE" refers to the phenomenon described by Halstead et al [6, 7] in which sub-neutralizing antibodies aid in uptake of virus and thus increase the replication of virus leading to more severed disease. ADE appears to depend largely on pan flavivirus antibodies [8].

As used herein the term "malaria" refers to members of the apicomplexan genus *Plasmodium*, and in particular to those species which cause clinical disease in humans including but not limited to *Plasmodium falciparum, P. vivax, P. malariae* and *P. ovale.*

As used herein all designations of malaria protein identification follow the *Plasmodium Genomics Resource at plasmoDB.org and correspond to the identities shown as of* 5 Aug. 2016, at which time Release 28 was in effect.

As used herein "ADAMTS13" and "A disintegrin and metalloproteinase with thrombospondin motifs 13" are used interchangeably and refer to the protein described in UniProt as ATS13 at uniprot.org/uniprot/ATS13_HUMAN and as further described in comparison with other related disintegrin and metalloproteinases by Porter et al [17]

As used herein "cardiovascular function proteins" are those curated in UniProt to have a role in the cardiovascular system structure and function, in blood flow, clotting, hemorrhage or expressed in any vascular cell, endothelial cell, platelet, or erythrocyte. More particularly the proteins encompassed in this category are those which are curated because they include a key word included in Table 28.

The term "virus-like particle" as used herein, refers to a non-infective viral subunit either with, or without, viral proteins. For example, a virus-like particle may completely lack the DNA or RNA genome. Further, a virus-like particle comprising viral capsid proteins may undergo spontaneous self-assembly. Preparations of virus-like particles are contemplated in one embodiment, where the preparation is purified free of infectious virions (or at least substantially free, such that the preparation has insufficient numbers to be infectious). Thus, the term "virus-like particle" and "VLP" includes a non-replicating viral shell that resembles live virus in external conformation. Methods for producing and characterizing recombinantly produced VLPs have been described for VLPs from several viruses, including human papilloma virus type 1 (Hagnesee et al. (1991) J. Virol. 67:315), human papilloma virus type 16 (Kirnbauer et al. Proc. Natl. Acad. Sci. (1992)89:12180), HIV-1 (Haffer et al., (1990) J. Virol. 64:2653), and hepatitis A (Winokur (1991) 65:5029). Additional methods for expressing VLPs that contain Newcastle Disease virus proteins are provided by Pantua et al. (2006) J. Virol. 80:11062-11073.

DESCRIPTION OF THE INVENTION

Zika virus is a flavivirus, first isolated in the Zika forest of Uganda in 1947 [18]. It is closely related to Spondewi virus, dengue, yellow fever, Japanese encephalitis virus, tick borne encephalitis virus, and West Nile virus [13]. In endemic areas, the Zika virus is transmitted by several species of *Aedes* mosquitoes, most particularly by *Aedes aegypti* and *Aedes albopictus* [18, 19]. Traditionally endemic in Africa and South East Asia [18], the Zika virus was isolated in French Polynesia in 2013 and 2014, where it was observed to be associated with cases of neonatal microencephaly and with Guillain Barré syndrome (GBS) [20]. In 2014 or late 2015 Zika virus was introduced into Brazil, a country where it had not previously been reported and where the population was fully naïve to infection [21]. It has since spread to most of Central and northern South America and the Caribbean (Centers for Disease Control and Prevention. Zika Virus, For Health Care Providers: Clinical Evaluation & Disease. 2015 Available from: cdc.gov/zika/hc-providers/clinicalevaluation.html. In August, 2016 autochthonous spread of Zika was confirmed in Florida and has now also been detected in Texas.

Primary Zika infection in healthy individuals is a minor disease causing a rash and fever of few days duration, with no deaths reported [1]. When Zika infects pregnant women in the first or second trimester, from 6-25% of livebirths are of microencephalitic infants [22, 23]. In addition, a rapid rise in the number of GBS cases has occurred the epidemic area, in some areas with a high mortality reported [24, 25]. While other flaviviruses are neurotropic, especially WNV, JEV, and TBEV, microencephaly and GBS are not reported following infection by these viruses. GBS has been reported sporadically following dengue infection [26]. While the introduction of Zika virus into an immunologically naïve population may well result in clinical signs that differ from those in endemic areas, there has been no clear explanation for the pathogenesis observed. Microencephaly is reported in other viral infections such as cytomegalovirus and rubella, but not for other flavivirus infections.

A particular puzzle has been why cases of severe Zika disease emerged as the virus spread outside the endemic zone of Africa and Southeast Asia, where the virus has been recognized for decades with no reports of microcephaly or GBS. These complications first appeared in French Polynesia. Microcephaly, encephalitis, and GBS have been reported in Martinique [27, 28]. Many reports of clinical Zika disease have come from patients returning home to northern countries (Europe, US etc.) from visits to endemic countries. In Brazil, severe Zika disease, and in particular microcephaly, has been clustered in the Northeastern part of the country [29] In one study an effort was made to pattern the distribution of Zika in Brazil relative to the inverse of where most intensive yellow fever vaccination has taken place [30].

Clearly there is a compelling and urgent need for development of interventions and diagnostics for ZIKV. This must be done however in the light of understanding of the pathogenesis of Zika associated neurologic symptoms and microcephaly.

Dengue is a major and rapidly expanding public health challenge in tropical and subtropical areas, responsible for hundreds of millions of infections and approaching 100 million clinical cases worldwide each year [31]. Caused by four closely related serotypes of flavivirus, it is a second infection with a different serotype which leads to the most severe cases of dengue, dengue hemorrhagic fever [8, 15]. Severe dengue and dengue hemorrhagic fever (DHF) is characterized by spontaneous hemorrhage, increased vascular permeability, hematuria and thrombocytopenia [5]. The severity of second infections has been attributed to the phenomenon of antibody dependent enhancement (ADE) in which prior antibody, which is not neutralizing, facilitates uptake of virus and enhances virus titer [3, 15]. The primary epitope conserved across all dengue envelope proteins is in the domain II of envelope protein, in the region known as the fusion loop [4]. While ADE undoubtedly contributes to the severity of dengue, it may not be the only factor. Recent studies of NS1, a non-structural protein which is shed into the extracellular space in large amounts in dengue, show that NS1 levels are a predictor of dengue severity [32] and that this may relate to the role of NS1 in focusing virus assembly [6, 7]. A puzzling aspect remains, which is that the severity of DHF peaks days after NS1 levels have diminished [8], indicating that other NS1 related factors may be in play.

Usutu virus (USUV) is another emerging flavivirus, first identified in South Africa in 1959, but recently associated with clinical cases in southern Europe [9], and now considered a threat to Latin America [10]. While not associated with major disease outbreaks in endemic areas, Usutu virus has been linked to fever, rash, and meningioencephalitis [9]. This pattern of clinical signs may change as Usutu virus moves into new geographic areas and populations not previously exposed.

Clearly there is a compelling and urgent need for development of preventive and therapeutic interventions and diagnostics for the emerging flaviviruses. The present invention builds on immunoinformatic analyses which have identified autoimmune pathogenesis, and which identify key epitopes and, hence, provide compositions and methods for design of countermeasures and diagnostics for dengue, Zika, and Usutu virus.

Figure 1:
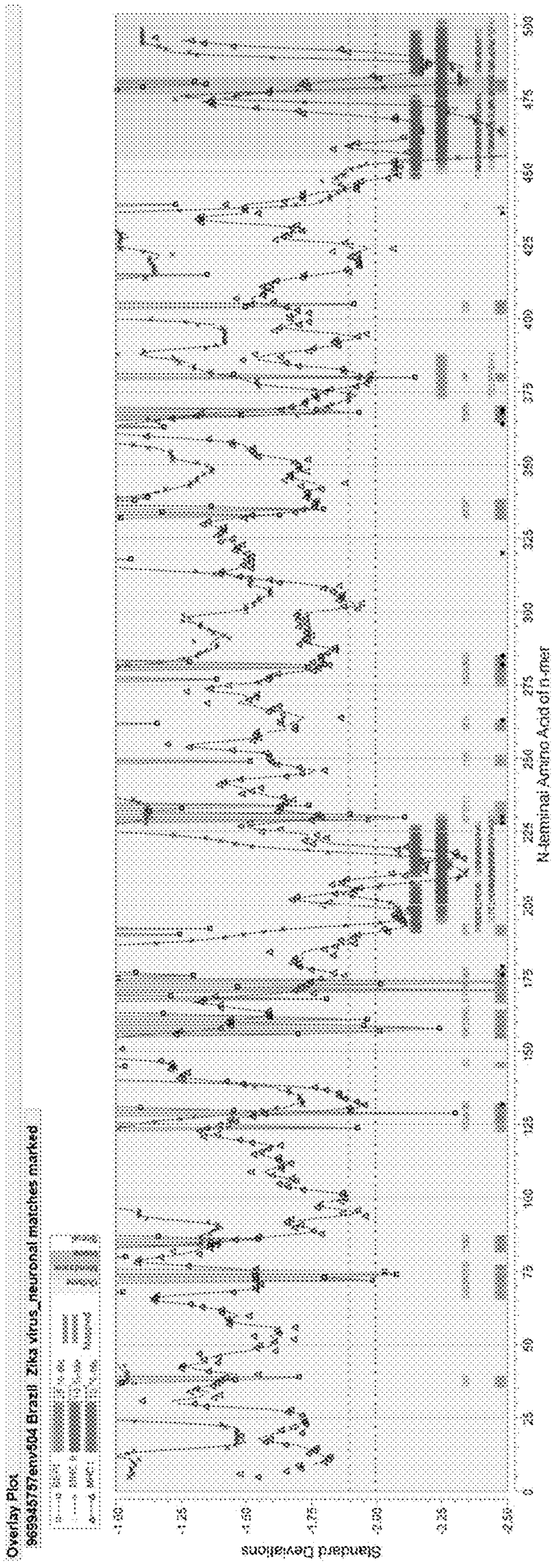
FIG. 1: Permuted population plot of the envelope of Zika virus (SPH2015, Brazil) showing location of B cell epitopes and population based MEW I and MEW II binding. In this population permuted plot: Predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).
Figure 2:
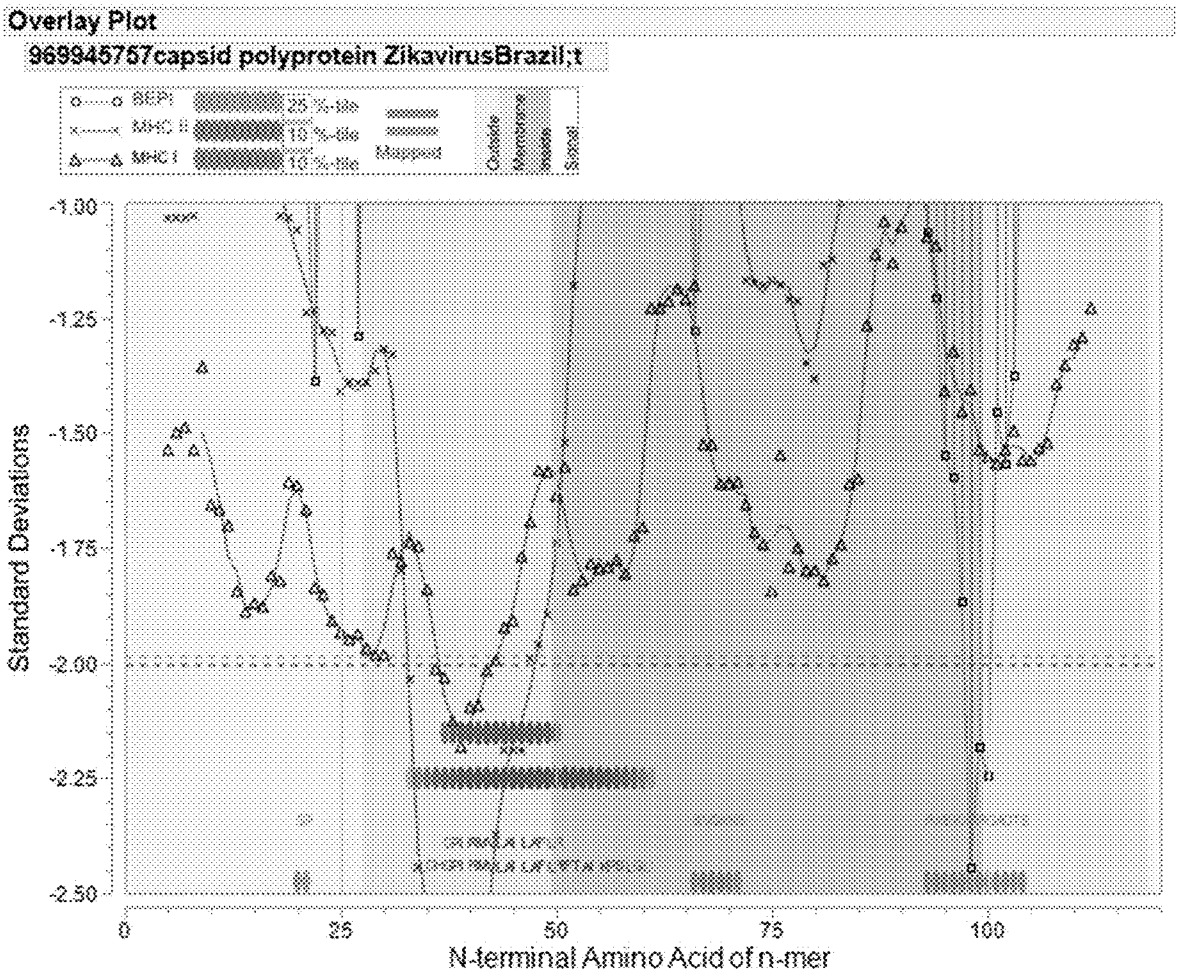
FIG. 2: Permuted population plot of the capsid protein of Zika virus (SPH2015, Brazil) showing location of B cell epitopes and population based MEW I and MEW II binding. In this population permuted plot: Predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).
Figure 3:
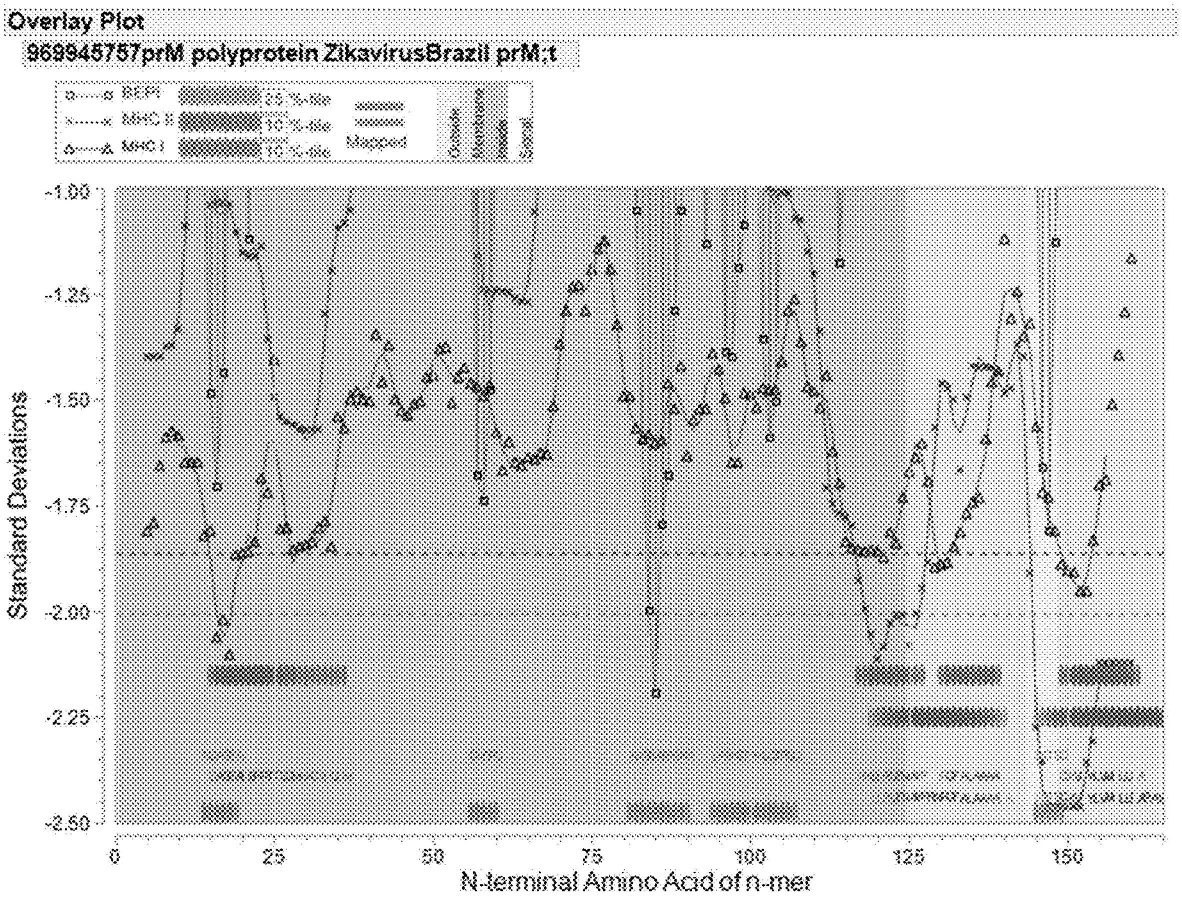
FIG. 3: Permuted population plot of the PrM of Zika virus (SPH2015, Brazil) showing location of B cell epitopes and population based MEW I and MEW II binding. In this population permuted plot: Predicted MHC-I (red line), MHC-II (blue line) binding, and probability of B cell binding (orange lines) for each peptide, arrayed N—C, for a permuted population comprising 63 human MHCs. Ribbons (Red=MHC-I, Blue-MHC-II) indicate the top 25% affinity binding. Orange bars indicate high probability B-cell binding. Background shading shows membrane (green) extramembrane (yellow), intramembrane (pink).
Figure 4:
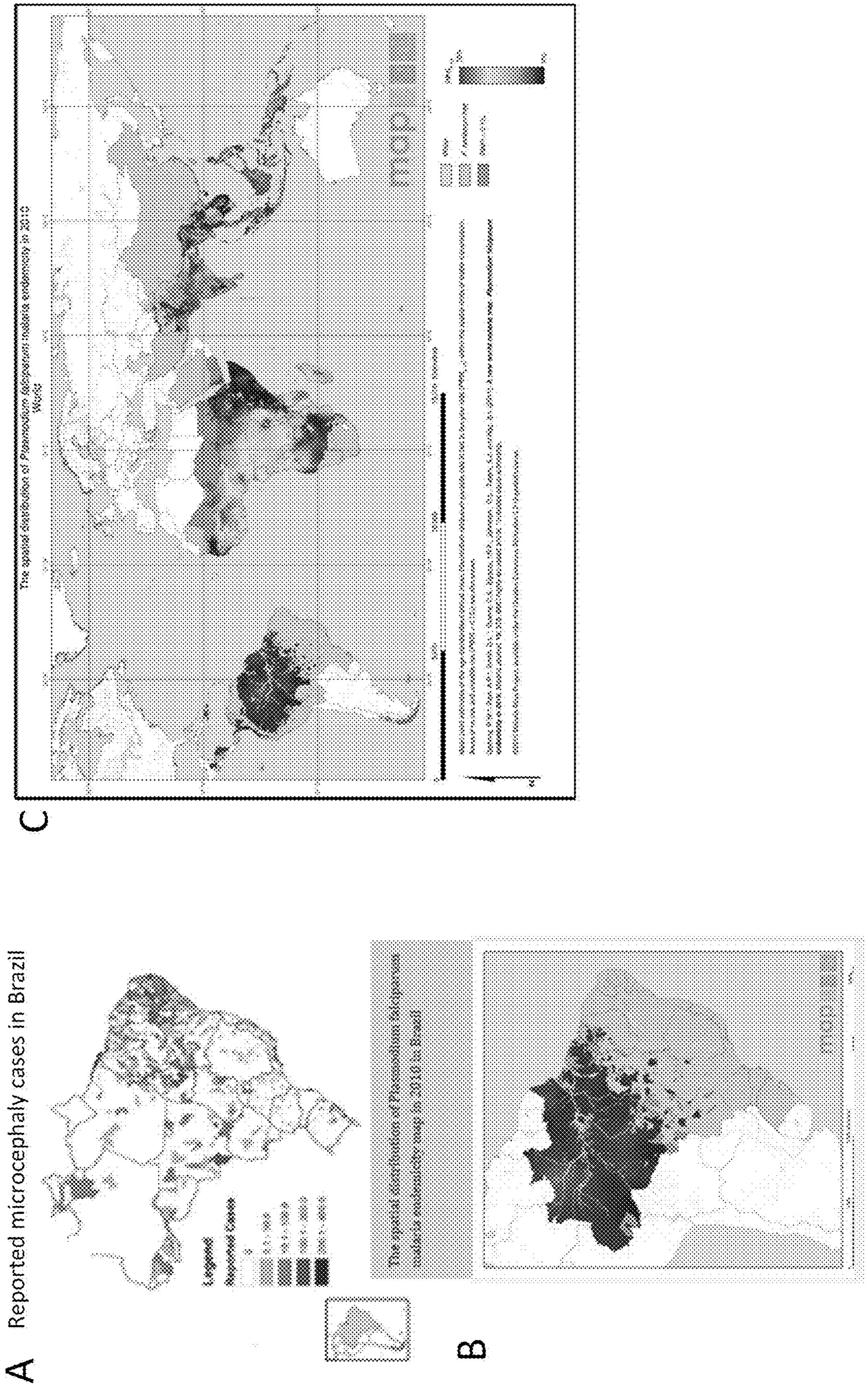
FIG. 4: Maps comparing distribution of *Plasmodium falciparum* and Zika

In the present invention, immunoinformatic analysis of B cell binding, MHC binding, cathepsin cleavage patterns, and T cell motifs as described previously (PCT US2011/029192, PCT US2012/055038, and US2014/01452, and U.S. Provisional Appl. 62/306,262 (each of which is incorporated herein by reference in its entirety) was used to arrive at a characterization of the immunologic characteristics of the Zika virus proteins. Examples of some of the output of such analysis for ZIKV are shown in FIGS. 1-3 (envelope, capsid and pre-membrane). Structurally, the envelope of ZIKV is very similar to other flaviviruses, based on comparison of maps of epitopes (FIG. 4). However, the amino acid sequence of Zika is quite different from that of other flaviviruses, sharing only one area of conservation, and likely antibody cross reactivity, in domain II.

By such epitope mapping approaches, the present invention describes the identification of those epitopes within the structural proteins of ZIKV which are likely to be cross reactive with other flaviviruses, and those which are specific to ZIKV. The association of B cell epitopes with MHC binding leading to effective T cell help is described, identifying epitopes most likely to yield high titers of antibody. Comparison of such mapping applied to Zika isolates from around the world allowed the demonstration that Zika envelope proteins have largely been conserved in sequence, but differ significantly from other flaviviruses. By extraction of B cell epitope motifs, we then compared pentamer peptides comprising B cell epitopes to pentamers in the entire human proteome, by reference to a database of epitope motifs we established previously (see, e.g., WO 2014/200910; herein incorporated by reference in its entirety). This enabled identification of matches to pentamers in the proteomes. These were then curated to identify proteins with neurologic function. From this shortlist, human proteins were also analyzed to identify B cell epitopes which would cross react with ZIKV antibodies. Other flaviviruses were compared to identify mimics unique to ZIKV, and in the case of dengue a mimic which may also be associated with GBS in dengue type 3.

Epitope mimics were identified in a number of areas in the ZIKV structural proteins. Domain III of the ZIKV protein contains a particularly critical motif which is unique, structurally exposed to antibodies, and which is associated with high MHC binding likely to result in high antibody titers. This epitope pentamer is homologous to a B cell epitope in neuropeptide Y (UniProtKB—P01303 (NPY_HUMAN)). Stimulation of high titers of antibody which bind/complex this neuropeptide at a critical stage of fetal development is consistent with the failure of brain development observed in the ZIKV affected infants and with the retinal lesions described in affected infants [33]. Antibodies cross the placenta and in first and second trimester can enter the developing brain in the absence of a fully formed blood brain barrier [34]. While exposure may only be for a few days or weeks and while fetal immunoglobulins may only reflect 10% of maternal titer [34], exposure at a critical time window is likely sufficient to affect cerebral development. There is precedent for this mode of intrauterine immunoglobulin mediated pathology [35, 36].

Primary infection with ZIKV is a minor febrile disease with a rash. However, GBS may arise after primary Zika infection. Antibodies to Zika at high titers, specific to the epitope mimic in Domain III that matched NPY, and which bind NPY could progressively deplete this protein, until such time as the antibody wanes and ongoing NPY production exceeds its depletion. This is consistent with the transient nature of GBS. GBS is a broad autoimmune syndrome with many causal mechanisms described, including autoimmune reactions with myelin and but also antibody interactions with gangliosides. Interestingly GBS has been reported occasionally following dengue. Dengue 3 shares a mimic with NPY, although this motif GEDAP (SEQ ID NO.: 539) is not found in Zika virus. However, the B cell epitope in DEN3 envelope protein lacks MHC II binding except for a few alleles, possibly accounting for the sporadic occurrence of GBS.

In this invention, we describe other mimics occurring in Zika virus which match other neural function proteins that may also play a role in pathogenesis. With the understanding that the pathogenesis of ZIKV neurologic effects, in particular GBS, are autoimmune and may arise from epitope mimics in the ZIKV proteins, it becomes imperative to design vaccines and therapeutics with this in mind. Failure to do so may result in further exacerbation of the disease pathogenesis.

ADE is of concern for all flaviviruses. Most ADE arises from non-neutralizing antibodies reactive with epitopes in the fusion loop Domain II of the envelope protein [4] and to a lesser extent antibodies reactive with PrM proteins [15]. As the Domain II epitope of dengue is shared with ZIKV and USUV, ADE may occur in sequential infections of one of these viruses before or after dengue [37], as it is in sequential infections with different serotypes of dengue.

In the case of Zika virus, a particular concern is that transplacental transfer of antibody is enabled by binding to the FcRn receptors on the placenta. In an embodiment of the present invention therefore it is particularly desirable to engineer an antibody devoid of Fc region to prevent or mitigate transplacental transfer.

While ADE undoubtedly contributes to the severity of flavivirus infections, it may not be the only factor. In the present invention, we address cardiovascular manifestations of Zika infection, as well as dengue and Usutu infections.

Infection with Zika virus has led to the development of deadly thrombocytopenia. [38, 39]. In even mild cases of ZIKV, USUV, or dengue infection, an erythremic rash is a typical clinical sign. Dengue is well known as a hemorrhagic disease, with dengue hemorrhagic fever occurring most typically following a second infection with a different serotype from the first infection. While for many years the role of ADE has been cited as a cause for this [15], there is increasing evidence that dengue does evoke an autoimmune response [40], that von Willebrand factor may be depleted [41], and that other clotting factors may be affected [42, 43]. Most recently the NS1 protein has been implicated as leading to vascular permeability in dengue [6, 7] and activating Toll receptor 4, and several possible direct viral pathogenic mechanisms have been described. However, the most serious vascular leakage in dengue hemorrhagic fever occurs after the peak of NS1 has declined, suggesting that a direct role of NS1 may not be the only factor [8]. In particular embodiments of the present invention, a subset of the human proteome was selected to include those proteins which have a function in the cardiovascular system, including structural proteins found in endothelium, platelets, erythrocytes, and enzymes expressed by these cells, and coagulation cascade proteins. In the present invention, we describe the role of NS1 in dengue in eliciting auto antibodies to various proteins with cardiovascular function, including but not limited to coagulation factor V and VIII, prothrombin, von Willebrand factor, ADAMTS13 (A disintegrin and metalloproteinase with thrombospondin motifs 13), platelet glycoprotein Ib beta, vascular endothelial growth factor, vascular endothelial growth factor receptor and platelet endothelial aggregation receptor. Notably no such epitope matches in cardiovascular function proteins clearly linked to hemorrhage and thrombocytopenia occur in the corresponding proteins of West Nile virus. In particular embodiments we describe the precise B cell epitopes which are mimics, thereby enabling the mutation or removal of such epitopes to reduce adverse effects in a vaccine.

A number of human proteins have been identified as having an association with microcephaly, for instance when this occurs as an autosomal recessive familial trait [44]. In another embodiment of the present invention, we therefore also examined whether antibodies arising from flavivirus infection, and in particular ZIKV, may bind to epitope mimics in the microcephaly associated proteins. As a linear B cell epitope is a charged and protruding or exposed peptide sequence, identification of a B cell linear epitope also identifies peptides which are probable candidates as other ligand binders. Thus, while identifying epitope mimics in the virus, as defined, the same process also identifies virus peptides which may be bound by other ligands which would otherwise bind with a human protein. Essentially the virus peptide becomes a competitor in binding and may thus disrupt a human-human protein binding reaction. The present invention identifies a number of epitope mimics shared between ZIKV and human microcephaly associated proteins. It thus shows the possibility of virus peptides which compete with microcephaly associated proteins for binding of ligands, including but not limited to antibody.

Accordingly, the present invention provides peptides, polypeptides and proteins, and nucleic acids sequences encoding the peptides, polypeptides and proteins as described in SEQ ID NOs: 1 to 1256. The sequences of the peptide, polypeptides, proteins and nucleic acids of the present invention are included in the accompanying Sequence ID listing. It will be understood to a person of skill in that the present invention encompasses the listed sequences as well as portions of the listed sequences. For example, in some cases, the listed sequences contain a polypeptide of interest (e.g., a viral or human sequence) in association with exogenous sequences such as signal peptide sequences and linker sequences. In these instances, it will be understood that the invention by defined by designated the portion of the sequence that is the viral polypeptide sequence in isolation from the associated exogenous sequences. The invention may also be defined by describing the viral polypeptide sequence in association with one or more of the exogenous sequences. For example, the invention may be defined by specifically designating a particular range of amino acids or nucleotides from the listed sequence corresponding to the polypeptide of interest or to the polypeptide of interest and one or more of the associated exogenous or flanking sequences.

For example, in some embodiments, the present invention provides a synthetic Zika virus polypeptide comprising one or more B cell epitopes and one or more peptides that each bind with high affinity to three or more different WIC II molecules. In some embodiments, the polypeptide comprises B cell epitopes that are unique to Zika virus and do not elicit antibodies which cross react with a dengue virus. In some embodiments, the polypeptide comprises one or more altered or deleted epitope mimic sequences so that the sequence of the synthetic Zika virus polypeptide is altered in comparison to the corresponding wild type Zika virus polypeptide (e.g., the polypeptide comprising one or more altered or deleted epitope mimic sequences comprises a deletion or substitution mutation of one or more amino acids in the epitope mimic sequence so that the sequence of synthetic Zika virus polypeptide is altered in comparison to the corresponding wild type Zika virus polypeptide). In some embodiments, the epitope mimic sequence is found in a human neurologic protein (e.g., a human neurologic protein listed in tables 1, 6, 7, 8 or 9). In some embodiments, the epitope mimic sequences are selected from, for example, SEQ ID NOs: 1-34, 78-140, or 255-256. In some embodiments, the synthetic polypeptide comprises a Zika virus immunogen from an envelope polypeptide of Zika virus (e.g., Zika virus Domain I, Domain II, or Domain III polypeptides). In some embodiments, the Zika virus immunogen is an immunogen encoded by an amino acid sequence selected from, for example, amino acids 38-444 of SEQ ID NO: 142, amino acids 38-143 of SEQ ID NO: 144, amino acids 38-125 of SEQ ID NO: 146, amino acids 38-113 of SEQ ID NO: 148, amino acids 24-429 of SEQ ID NO: 150, amino acids 24-128 of SEQ ID NO: 152, amino acids 24-110 of SEQ ID NO: 154, amino acids 24-98 of SEQ ID NO: 156, amino acids 30-435 of SEQ ID NO: 158, amino acids 30-134 of SEQ ID NO: 160, amino acids 30-116 of SEQ ID NO: 162, amino acids 30-104 of SEQ ID NO: 164, amino acids 38-143 of SEQ ID NO: 166, amino acids 24-128 of SEQ ID NO: 168, amino acids 30-134 of SEQ ID NO: 170, or amino acids 38-444 of SEQ ID NO: 254. In some embodiments, the epitope mimic sequence is found in a human microcephaly associated protein (e.g., CDKRAP2, ASPM, or CEP135). In some embodiments, the epitope mimic sequence is selected from the group of epitope mimic sequences identified by SEQ ID NOs: 452-456. In some embodiments, the synthetic polypeptide comprises a Zika virus immunogen from a Zika virus protein selected from PrM, NS1, NS3, or NS4B. In some embodiments, the Zika virus immunogen is an NS1 immunogen encoded by an amino acid sequence selected from, for example, amino acids 21 to 384 of SEQ ID NO:441, amino acids 21 to 213 of SEQ ID NO:443 or amino acids 21 to 213 of SEQ ID NO:445.

Further embodiments provide a synthetic flavivirus NS1 polypeptide comprising one or more B cell epitopes and that comprise peptides that bind with high affinity to three or more different MHC II molecules. In some embodiments, the polypeptide is selected from, for example, a dengue virus NS1 polypeptide, Zika virus NS1 polypeptide, West Nile virus NS1 polypeptide, Yellow fever virus NS1 polypeptide, Usutu virus NS1 polypeptide, Japanese encephalitis virus NS1 polypeptide, Tickborne encephalitis virus NS1 polypeptide, or St Louis encephalitis virus NS1 polypeptide. In some embodiments, the polypeptide comprises one or more altered or deleted epitope mimic sequences so that the sequence of the synthetic polypeptide is altered in comparison to the corresponding wild type virus polypeptide. In some embodiments, the polypeptide comprising one or more altered or deleted epitope mimic sequences comprises a deletion or substitution mutation of one or more amino acids in the epitope mimic sequence so that the sequence of the synthetic virus polypeptide is altered in comparison to the corresponding wild type virus polypeptide. In some embodiments, the epitope mimic sequence matches an epitope motif in a human cardiovascular protein (e.g., a human protein expressed in vascular endothelium or in platelets). In some embodiments, the human cardiovascular protein is selected from, for example, ADAMTS13, Coagulation factor V, Coagulation factor VIII, Plasminogen, Platelet glycoprotein Ib beta chain, Vascular endothelial growth factor A, Vascular endothelial growth factor B, Vascular endothelial growth factor receptor 1, Vascular endothelial growth factor receptor 2, von Willebrand factor or Platelet endothelial aggregation receptor 1. In some embodiments, the epitope mimic sequences are selected from the group of epitope mimic sequences identified by SEQ ID NOs:1106-1123. In some embodiments, the epitope mimic sequence matches an epitope motif in a human protein with neurologic function. In some embodiments, the epitope mimic sequences are selected from, for example, SEQ ID NOs:1124-1125 and 1138-1149. In some embodiments, the synthetic polypeptide comprises Zika PrM and Env proteins in operable linkage. In some embodiments, the polypeptide is encoded by amino acids 25 to 603 of SEQ ID NO:258, amino acids 25 to 603 of SEQ ID NO:260, or amino acids 25 to 603 of SEQ ID NO:262. In some embodiments, the synthetic polypeptide comprises one or more altered or deleted pan-flavivirus epitopes so that the sequence of the synthetic Zika virus polypeptide is altered in comparison to the corresponding wild type Zika virus polypeptide. In some embodiments, the pan-flavivirus epitope is DRGWG (SEQ ID NO:554).

Further embodiments provide a fusion protein comprising the synthetic polypeptides described herein. In some embodiments, the fusion protein comprises a peptide sequence selected from a signal sequence, a linker sequence, a purification tag sequence and an immunoglobulin sequence in operable association with the synthetic polypeptide. In some embodiments, the peptide sequence is exogenous to the synthetic polypeptide sequence. In some embodiments, the immunoglobulin sequence is a constant region sequence.

In other embodiments, the present invention provides a synthetic human neurological polypeptide comprising one or more altered or deleted epitope mimic sequences so that the sequence of the synthetic neurological polypeptide is altered in comparison to the corresponding wild type neurological polypeptide and wherein the epitope mimic sequence is shared with a B cell epitope in a Zika virus or dengue virus. In some embodiments, the polypeptide comprising one or more altered or deleted epitope mimic sequences comprises a deletion or substitution mutation of one or more amino acids in the epitope mimic sequence so that the sequence of synthetic neurological polypeptide is altered in comparison to the corresponding wild type neurological polypeptide. In some embodiments, the human neurological polypeptide is proneuropeptide Y or neuron navigator 2. In some embodiments, the polypeptide comprises an amino acid sequence selected from, for example, amino acids 35-104 of SEQ ID NO:174, amino acids 35-104 of SEQ ID NO:176, amino acids 35-104 of SEQ ID NO:178, amino acids 35-104 of SEQ ID NO: 180, amino acids 35-104 of SEQ ID NO:182, amino acids 30-270 of SEQ ID NO:236, amino acids 30-270 of SEQ ID NO:238, amino acids 30-270 of SEQ ID NO:240, amino acids 30-270 of SEQ ID NO:242, amino acids 30-280 of SEQ ID NO:244, amino acids 30 to 269 of SEQ ID NO.: 399, amino acids 30 to 269 of SEQ ID NO.:401, amino acids 30 to 269 of SEQ ID NO.:403, amino acids 30 to 269 of SEQ ID NO.:405, amino acids 30 to 279 of SEQ ID NO.:407, amino acids 268 to 507 of SEQ ID NO.:409, amino acids 268 to 507 of SEQ ID NO.:411, amino acids 268 to 507 of SEQ ID NO.:413, amino acids 268 to 507 of SEQ ID NO.:415, amino acids 268 to 507 of SEQ ID NO.:417, amino acids 30 to 100 of SEQ ID NO.:419, amino acids 30 to 100 of SEQ ID NO.:421, amino acids 30 to 100 of SEQ ID NO.:423, amino acids 30 to 100 of SEQ ID NO.:425, amino acids 30 to 110 of SEQ ID NO.:427, amino acids 268 to 338 of SEQ ID NO.:429, amino acids 268 to 338 of SEQ ID NO.:431, amino acids 268 to 338 of SEQ ID NO.:433, amino acids 268 to 338 of SEQ ID NO.:435, or amino acids 268 to 348 of SEQ ID NO.:437.

Other embodiments provide a synthetic polypeptide derived from a human microcephaly associated protein comprising one or more altered or deleted epitope mimic sequences so that the sequence of the synthetic polypeptide is altered in comparison to the corresponding wild type human microcephaly associated protein and wherein the epitope mimic sequence is shared with a B cell epitope in a Zika virus or dengue virus. In some embodiments, the polypeptide comprising one or more altered or deleted epitope mimic sequences comprises a deletion or substitution mutation of one or more amino acids in the epitope mimic sequence so that the sequence of synthetic polypeptide is altered in comparison to the corresponding wild type human microcephaly associated protein (e.g., ASPM).

As described above, in some preferred embodiments, the present invention provides synthetic or variant viral or human polypeptide sequences (or the corresponding nucleic acid sequences) that have a mutation such as a substitution mutation or deletion mutation in one or more epitope mimic sequences. In some embodiments, the mutation is a deletion mutation that removes all or part of the epitope mimic so that the polypeptide does not cross react with antibodies specific for the wild type epitope mimic. In some embodiments, the mutation is a substitution mutation or insertion mutation that alters the epitope mimic so that the polypeptide does not cross react with antibodies specific for the wild type epitope mimic. Thus, the sequences of the present invention may be described by reference to the wild type viral or human sequence and then specifying that a particular epitope mimic sequence (or sequences) in the wild type sequence is mutated to alter or delete the specified epitope mimic sequence. Those of skill in the art will recognize that there are a number of different ways the epitope mimic sequence may be altered or deleted by mutation and will recognize that the identity of the specified sequence may readily be determined by reference to the corresponding wild type sequence.

In some embodiments, a peptide or polypeptide sequence (e.g., an epitope mimic sequence, altered epitope mimic sequence, or in some preferred embodiments a pentamer or other peptide sequence defined in the tables in the examples) of the present invention includes a flanking sequence extending beyond the region comprising the identified peptide. The flanking sequence may be included on either or both of the C and/or N terminals of the peptide and may be a native or wild type flanking sequence or a flanking sequence that is exogenous to the peptide (i.e., a flanking sequence that does not naturally occur with the peptide). Such a flanking sequence may be used in assuring a synthetic version of the peptide is displayed in such a way as to represent the topological arrangement in its native state. For instance, inclusion of a flanking sequence at each end and inclusion of a cysteine residue may be used to ensure a peptide is displayed on a loop. Flanking sequences may be included to allow multiple peptides to be arranged together to epitopes that occur adjacent to each other in a native protein. A flanking sequence may be used to facilitate expression as a fusion polypeptide, for instance linked to an immunoglobulin Fc region to ensure secretion. In such embodiments where flanking regions are included said flanking regions may comprise from 1-20, from 1-50, from 10-20, 20-30 or 40-50, or up to 100 amino acids on either or both of the N terminal end or the C terminal end of the epitope polypeptide. In some embodiments, these peptides and polypeptides find use as capture reagents in the diagnostic assays below, or find use a components of vaccines such as subunit vaccines.

In some embodiments, the present invention provides sequences that are homologous or variants of the sequences described above. It will be recognized that the sequences described above can be altered, for example by substituting one or more amino acids in the sequences with a different amino acid. The substitutions may be made in the listed sequence or in the flanking regions. Such mutated or variant sequences are within the scope of the invention. It will further be recognized by those of skill in the art that where the sequence is identified as having an altered or deleted epitope mimic sequence, that the defined sequence may include mutations in other portions of the defined sequence. These sequences may be described by defining the sequence as having a particular identity or homology to the defined sequence, with the proviso that that the mutations that the alterations or deletions of the defined epitope mimic sequence are retained. In other words, where for example, the sequence is defined as having 95% identity or homology or some other percent identity or homology to a defined sequence having an altered epitope mimic sequence, it will be understood to a person of ordinary skill in the art that the sequence retains the alterations to the defined epitope mimic sequence so that the function of the defined epitope mimic sequence is not destroyed (i.e., the altered sequence does not bind to antibodies specific for the wild type epitope mimic sequence or the epitope mimic sequence is removed from the viral polypeptide) while having additional variations in the other portions of the sequence so that identity or homology to the defined sequence is at least 95% or some other percent identity.

The substitutions may be conservative or non-conservative. Accordingly, in some embodiments, the present invention provides polypeptide sequences that share at least 70%, 75%, 80%, 85%, 90%, 95%, 96%, 97%, 98%, or 99% identity with the listed sequence, relative to the epitope portion of the listed sequences (e.g., excluding non-epitope sequences). In some embodiments, variant sequences retain the epitope of the recited sequence. In some embodiments, the variant sequences have about 1, 2, 3, 4, 5, 6, 7, 8, 9 or 10 amino acid substitutions, or a range of substitutions from about 1 to about 10 substitutions, for example 1-4 substitutions, 2-4 substitutions, 3-5 substitutions, 5-10 substitutions, etc. The substitutions may be conservative or non-conservative.

As used herein, a "conservative" amino acid substitution refers to the substitution of an amino acid in a peptide or polypeptide with another amino acid having similar chemical properties, such as size or charge. For purposes of the present disclosure, each of the following eight groups contains amino acids that are conservative substitutions for one another:

1) Alanine (A) and Glycine (G);
2) Aspartic acid (D) and Glutamic acid (E);
3) Asparagine (N) and Glutamine (Q);
4) Arginine (R) and Lysine (K);
5) Isoleucine (I), Leucine (L), Methionine (M), and Valine (V);
6) Phenylalanine (F), Tyrosine (Y), and Tryptophan (W);
7) Serine (S) and Threonine (T); and
8) Cysteine (C) and Methionine (M).

Naturally occurring residues may be divided into classes based on common side chain properties, for example: polar positive (histidine (H), lysine (K), and arginine (R)); polar negative (aspartic acid (D), glutamic acid (E)); polar neutral (serine (S), threonine (T), asparagine (N), glutamine (Q)); non-polar aliphatic (alanine (A), valine (V), leucine (L), isoleucine (I), methionine (M)); non-polar aromatic (phenylalanine (F), tyrosine (Y), tryptophan (W)); proline and glycine; and cysteine. As used herein, a "semi-conservative" amino acid substitution refers to the substitution of an amino acid in a peptide or polypeptide with another amino acid within the same class.

In some embodiments, unless otherwise specified, a conservative or semi-conservative amino acid substitution may also encompass non-naturally occurring amino acid residues that have similar chemical properties to the natural reside. These non-natural residues are typically incorporated by chemical peptide synthesis rather than by synthesis in biological systems. These include, but are not limited to, peptidomimetics and other reversed or inverted forms of amino acid moieties. Embodiments herein may, in some embodiments, be limited to natural amino acids, non-natural amino acids, and/or amino acid analogs.

Non-conservative substitutions may involve the exchange of a member of one class for a member from another class.

The present invention therefore embodies a number of embodiments that enable the development of safe and effective diagnostic, research, and medical interventions.

Vectors and Recombinant Expression:

In some embodiments, the present invention provides vectors and recombinant expression systems for expressing peptides and constructs described herein. The present invention is not limited to particular expression vectors. Exemplary vectors and expression methods are described herein.

In some embodiments, peptides are expressed using any suitable vector and expression system. In some embodiments, peptides are expressed in bacterial or eukaryotic expression vectors (e.g., commercially available vectors). In some embodiments, peptides are expressed in retroviral (e.g., adeno, adeno-associated, or lenti-viral vectors). Suitable vectors are introduced into suitable host cells (e.g., bacterial or eukaryotic host cells), expression is induced, and peptides are isolated using any suitable method.

The peptides, polypeptides, and proteins of the present invention may be produced by recombinant techniques. Thus, for example, a polynucleotide encoding a peptide, polypeptide or protein of the present invention may be included in any one of a variety of expression vectors for expressing a polypeptide. In some embodiments of the present invention, vectors include, but are not limited to, chromosomal, nonchromosomal and synthetic DNA sequences (e.g., derivatives of SV40, bacterial plasmids, phage DNA; baculovirus, yeast plasmids, vectors derived from combinations of plasmids and phage DNA, retroviral vectors and viral DNA such as vaccinia, adenovirus, fowl pox virus, and pseudorabies). It is contemplated that any vector may be used as long as it is replicable and viable in the host.

In particular, some embodiments of the present invention provide recombinant constructs comprising one or more of the sequences as broadly described above. In some embodiments of the present invention, the constructs comprise a vector, such as a plasmid or viral vector, into which a sequence of the invention has been inserted, in a forward or reverse orientation. In still other embodiments, the heterologous structural sequence is assembled in appropriate phase with translation initiation and termination sequences. In preferred embodiments of the present invention, the appropriate DNA sequence is inserted into the vector using any of a variety of procedures. In general, the DNA sequence is inserted into an appropriate restriction endonuclease site(s) by procedures known in the art.

Large numbers of suitable vectors are known to those of skill in the art, and are commercially available. Such vectors include, but are not limited to, the following vectors: 1) Bacterial—pQE70, pQE60, pQE-9 (Qiagen), pBS, pD10, phagescript, psiX174, pbluescript SK, pBSKS, pNH8A, pNH16a, pNH18A, pNH46A (Stratagene); ptrc99a, pKK223-3, pKK233-3, pDR540, pRIT5 (Pharmacia); 2) Eukaryotic—pWLNEO, pSV2CAT, pOG44, PXT1, pSG (Stratagene) pSVK3, pBPV, pMSG, pSVL (Pharmacia); and 3) Baculovirus—pPbac and pMbac (Stratagene). Any other plasmid or vector may be used as long as they are replicable and viable in the host. In some preferred embodiments of the present invention, mammalian expression vectors comprise an origin of replication, a suitable promoter and enhancer, and also any necessary ribosome binding sites, polyadenylation sites, splice donor and acceptor sites, transcriptional termination sequences, and 5' flanking non-transcribed sequences. In other embodiments, DNA sequences derived from the SV40 splice, and polyadenylation sites may be used to provide the required non-transcribed genetic elements.

In certain embodiments of the present invention, the DNA sequence in the expression vector is operatively linked to an appropriate expression control sequence(s) (promoter) to direct mRNA synthesis. Promoters useful in the present invention include, but are not limited to, the LTR or SV40 promoter, the *E. coli* lac or trp, the phage lambda $P_L$ and $P_R$, T3 and T7 promoters, and the cytomegalovirus (CMV) immediate early, herpes simplex virus (HSV) thymidine kinase, and mouse metallothionein-I promoters and other promoters known to control expression of gene in prokaryotic or eukaryotic cells or their viruses. In other embodiments of the present invention, recombinant expression vectors include origins of replication and selectable markers permitting transformation of the host cell (e.g., dihydrofolate reductase or neomycin resistance for eukaryotic cell culture, or tetracycline or ampicillin resistance in *E. coli*).

In some embodiments of the present invention, transcription of the DNA encoding the polypeptides of the present invention by higher eukaryotes is increased by inserting an enhancer sequence into the vector. Enhancers are cis-acting elements of DNA, usually about from 10 to 300 bp that act on a promoter to increase its transcription. Enhancers useful in the present invention include, but are not limited to, the SV40 enhancer on the late side of the replication origin bp 100 to 270, a cytomegalovirus early promoter enhancer, the polyoma enhancer on the late side of the replication origin, and adenovirus enhancers.

In other embodiments, the expression vector also contains a ribosome binding site for translation initiation and a transcription terminator. In still other embodiments of the present invention, the vector may also include appropriate sequences for amplifying expression.

In some embodiments, retroviral vectors are utilized for expression in a suitable host cell. The production of a recombinant retroviral vector carrying a gene of interest is typically achieved in two stages. First, the gene of interest is inserted into a retroviral vector which contains the sequences necessary for the efficient expression of the gene of interest (including promoter and/or enhancer elements which may be provided by the viral long terminal repeats [LTRs] or by an internal promoter/enhancer and relevant splicing signals), sequences required for the efficient packaging of the viral RNA into infectious virions (e.g., the packaging signal [Psi], the tRNA primer binding site [−PBS], the 3' regulatory sequences required for reverse transcription [+PBS] and the viral LTRs). The LTRs contain sequences required for the association of viral genomic RNA, reverse transcriptase and integrase functions, and sequences involved in directing the expression of the genomic RNA to be packaged in viral particles. For safety reasons, many recombinant retroviral vectors lack functional copies of the genes that are essential for viral replication (these essential genes are either deleted or disabled); the resulting virus is said to be replication defective or incompetent.

Second, following the construction of the recombinant vector, the vector DNA is introduced into a packaging cell line. Packaging cell lines provide viral proteins required in trans for the packaging of the viral genomic RNA into viral particles having the desired host range (i.e., the viral-encoded gag, pol and env proteins). The host range is controlled, in part, by the type of envelope gene product expressed on the surface of the viral particle. Packaging cell lines may express ecotrophic, amphotropic or xenotropic envelope gene products. Alternatively, the packaging cell line may lack sequences encoding a viral envelope (env) protein. In this case the packaging cell line will package the viral genome into particles that lack a membrane-associated protein (e.g., an env protein). In order to produce viral particles containing a membrane associated protein that will permit entry of the virus into a cell, the packaging cell line containing the retroviral sequences is transfected with sequences encoding a membrane-associated protein (e.g., the G protein of vesicular stomatitis virus [VSV]). The transfected packaging cell will then produce viral particles that contain the membrane-associated protein expressed by the transfected packaging cell line; these viral particles, which contain viral genomic RNA derived from one virus encapsidated by the envelope proteins of another virus are said to be pseudotyped virus particles.

Commonly used recombinant retroviral vectors are derived from the amphotropic Moloney murine leukemia virus (MoMLV) (Miller and Baltimore, Mol. Cell. Biol., 6:2895 [1986]). The MoMLV system has several advantages: 1) this specific retrovirus can infect many different cell types, 2) established packaging cell lines are available for the production of recombinant MoMLV viral particles and 3) the transferred genes are permanently integrated into the target cell chromosome. The established MoMLV vector systems comprise a DNA vector containing a small portion of the retroviral sequence (the viral long terminal repeat or "LTR" and the packaging or "psi" signal) and a packaging cell line. The gene to be transferred is inserted into the DNA vector. The viral sequences present on the DNA vector provide the signals necessary for the insertion or packaging of the vector RNA into the viral particle and for the expression of the inserted gene. The packaging cell line provides the viral proteins required for particle assembly (Markowitz et al., J. Virol., 62:1120 [1988]).

Other commonly used retrovectors are derived from lentiviruses including, but not limited to, human immunodeficiency virus (HIV) or feline immunodeficiency virus (FIV). Lentivirus vectors have the advantage of being able to infect non replicating cells.

The low titer and inefficient infection of certain cell types by retro vectors has been overcome by the use of pseudotyped retroviral vectors which contain the G protein of VSV as the membrane associated protein. Unlike retroviral envelope proteins which bind to a specific cell surface protein receptor to gain entry into a cell, the VSV G protein interacts with a phospholipid component of the plasma membrane (Mastromarino et al., J. Gen. Virol., 68:2359 [1977]). Because entry of VSV into a cell is not dependent upon the presence of specific protein receptors, VSV has an extremely broad host range. Pseudotyped retroviral vectors bearing the VSV G protein have an altered host range characteristic of VSV (i.e., they can infect almost all species of vertebrate, invertebrate and insect cells). Importantly, VSV G-pseudotyped retroviral vectors can be concentrated 2000-fold or more by ultracentrifugation without significant loss of infectivity (Burns et al., Proc. Natl. Acad. Sci. USA, 90:8033 [1993]).

The VSV G protein has also been used to pseudotype retroviral vectors based upon the human immunodeficiency virus (HIV) (Naldini et al., Science 272:263 [1996]). Thus, the VSV G protein may be used to generate a variety of pseudotyped retroviral vectors and is not limited to vectors based on MoMLV.

The majority of retroviruses can transfer or integrate a double-stranded linear form of the virus (the provirus) into the genome of the recipient cell only if the recipient cell is cycling (i.e., dividing) at the time of infection. Retroviruses that have been shown to infect dividing cells exclusively, or more efficiently, include MLV, spleen necrosis virus, Rous sarcoma virus human immunodeficiency virus, and other lentiviral vectors.

In some embodiments, peptides are synthesized de novo. A variety of peptide synthesis methods may be utilized. Examples include, but are not limited to, solid-phase peptide synthesis (SPPS), (R. B. Merrifield (1963). "Solid Phase Peptide Synthesis. I. The Synthesis of a Tetrapeptide". J. Am. Chem. Soc. 85 (14): 2149-2154; Mitchell, A. R. K., S. B. H.; Engelhard, M.; Merrifield, R. B. (1978). "A new synthetic route to tert-butyloxycarbonylaminoacyl-4-(oxymethyl)phenylacetamidomethyl-resin, an improved support for solid-phase peptide synthesis". J. Org. Chem. 43 (13): 2845-2852). Recent developments in synthesis methods are further described in Hojo, Curr Opin Struct Biol 2014, 26C, 16-23; Ramakers et al., Chem Soc Rev 2014, 43, 2743-2756 and Chandrudu et al., Molecules 2013, 18, 4373-4388.

In a further embodiment, the present invention provides host cells containing the above-described constructs. In some embodiments of the present invention, the host cell is a higher eukaryotic cell (e.g., a mammalian or insect cell). In other embodiments of the present invention, the host cell is a lower eukaryotic cell (e.g., a yeast cell). In still other embodiments of the present invention, the host cell can be a prokaryotic cell (e.g., a bacterial cell). Specific examples of host cells include, but are not limited to, *Escherichia coli, Salmonella typhimurium, Bacillus subtilis*, and various species within the genera *Pseudomonas, Streptomyces*, and *Staphylococcus*, as well as Saccharomycees cerivisiae, Schizosaccharomycees *pombe, Drosophila* S2 cells, *Spodoptera* Sf9 cells, Chinese hamster ovary (CHO) cells, COS-7 lines of monkey kidney fibroblasts, (Gluzman, Cell 23:175 (1981)), C127, 3T3, 293, 293T, HeLa and BHK cell lines, T-1 (tobacco cell culture line), root cell and cultured roots in rhizosecretion (Gleba et al., (1999) Proc Natl Acad Sci USA 96:5973-5977).

The constructs in host cells can be used in a conventional manner to produce the gene product encoded by the recombinant sequence. In some embodiments, introduction of the construct into the host cell can be accomplished by calcium phosphate transfection, DEAE-Dextran mediated transfection, or electroporation (See e.g., Davis et al. (1986) Basic Methods in Molecular Biology). Alternatively, in some embodiments of the present invention, the polypeptides of the invention can be synthetically produced by conventional peptide synthesizers.

Proteins can be expressed in mammalian cells, yeast, bacteria, or other cells under the control of appropriate promoters. Cell-free translation systems can also be employed to produce such proteins using RNAs derived from the DNA constructs of the present invention. Appropriate cloning and expression vectors for use with prokaryotic and eukaryotic hosts are described by Sambrook, et al. (1989) Molecular Cloning: A Laboratory Manual, Second Edition, Cold Spring Harbor, N.Y.

In some embodiments of the present invention, following transformation of a suitable host strain and growth of the host strain to an appropriate cell density, the selected promoter is induced by appropriate means (e.g., temperature shift or chemical induction) and cells are cultured for an additional period. In other embodiments of the present invention, cells are typically harvested by centrifugation, disrupted by physical or chemical means, and the resulting crude extract retained for further purification. In still other embodiments of the present invention, microbial cells employed in expression of proteins can be disrupted by any convenient method, including freeze-thaw cycling, sonication, mechanical disruption, or use of cell lysing agents.

Vaccines:

A first set of embodiments addresses development of vaccines to prevent Zika infection in those at risk of infection. In some particular embodiments, sequences of proteins included in Zika vaccines are selected based on understanding of epitope mimics, in order to direct antibody responses to preferred epitopes. In particular embodiments of the invention, the sub polypeptides of the ZIKV envelope protein have been engineered to remove or to mutate peptides which are identified as epitope mimics for human proteins. In some cases, said human proteins are proteins which affect neurologic function and development. In particular cases, said epitope mimics occur in human neuropeptide Y. In yet other embodiments said mimic is in another neural protein, including, but not limited to, neurotrophin 4, neural cell adhesion molecule, neuron navigator, neurogenic differentiation factor, optineurin, cochlin, glial fibrillary acidic protein, glycoprotein M6A and others. In some particular embodiments, the epitope mimics located in Domain III loop and comprising amino acid motifs shown herein, are mutated or removed. In yet other embodiments peptide motifs in Domain I are modified to eliminate potential mimics. In some particular embodiments, a mimic, comprising the pentamer PRAEA, is found in Domain I which corresponds to an epitope in optineurin. In another embodiment, a mimic in Domain II comprising the pentamer MSSGT is found to match a B cell epitope in brain derived neurotrophic factor and in cochlin. In some embodiments, synthetic polypeptides are expressed which comprise sequences from which amino acids are deleted or mutated relative to the sequences in the native protein, to abrogate the mimic motif.

In yet other embodiments a polypeptide is selected from the structural proteins of ZIKV which avoids the identified problematic mimic motifs. For example, in some embodiments, the polypeptide comprises B cell epitopes that are unique to Zika virus and do not elicit antibodies which cross react with a dengue virus. In some embodiments, the polypeptide comprises one or more altered or deleted epitope mimic sequences so that the sequence of the synthetic Zika virus polypeptide is altered in comparison to the corresponding wild type Zika virus polypeptide. In some embodiments, the comprises one or more altered or deleted epitope mimic sequences comprising a deletion or substitution mutation of one or more amino acids in the epitope mimic sequence so that the sequence of the Zika virus polypeptide is altered in comparison to the corresponding wild type Zika virus polypeptide. In some embodiments, the polypeptide does not contain mimic from human proteins (e.g., human neurologic proteins such as those described in Tables 1, 6, 7, 8, and 9). Exemplary epitope mimetics are shown, for example, in SEQ ID NOs: 1-34, 78-140, and 255-256. In some embodiments, vaccines utilize variants of the described peptides or comprise flanking sequence as described above.

In some embodiments of the present invention, a synthetic envelope polypeptide is engineered to avoid including the potentially cross reactive sequences in Domain II which could lead to ADE if a prior infection with dengue or other flaviruses has occurred or follows Zika infection.

In addition to the embodiments described above, the identification of an epitope mimic GEDAP (SEQ ID NO.: 539) for dengue virus in neuropeptide Y raises concern that dengue virus vaccines may generate antibodies with deleterious neuropeptide binding properties unless modified to eliminate the epitope mimic. The motif GEDAP (SEQ ID NO.: 539) is found in most lineages of dengue serotype 3, including those circulating where ZIKV is currently endemic in Latin America. In a similar pattern, we have shown that Dengue serotype 1 carries a peptide mimic which matches an epitope in neural navigator protein 2. In this case, the motif TDKEK, found in domain III of dengue 1, is highly conserved. Hence modifications of envelope proteins or subunits thereof to remove such epitope mimics for dengue 1 and dengue 3 will lead to greater safety especially when such vaccines are used in an area co-endemic for Zika virus which also carries mimics for these two target proteins. It will be apparent to those skilled in the art that additional neurologic peptides within dengue virus, including dengue types 1, 2, 3 or 4, may be identified using the strategy described herein and that it will be desirable to mutate or remove the mimic peptides from vaccines in the interests of safety to avoid autoimmune reactions.

A further set of embodiments addresses development of vaccines containing NS1 of dengue and other flaviviruses, in which one or more epitope mimics capable of eliciting an autoimmune reaction are removed or mutated. In particular embodiments, NS1 epitopes are mimics of B cell epitopes which occur in cardiovascular function proteins. Of particular note is an embodiment in which we identify a mimic epitope pentamer, in the C terminal loop of dengue viruses, conserved in serotypes 1-4, which matches a B cell epitope in ADAMTS13. Multiple stimulations by this epitope, whether through natural infection or vaccination, or vaccination followed by repeated natural exposure would increase the titer of antibodies binding this enzyme with potentially deleterious effects. We also identify a mimic for platelet glycoprotein Ib beta chain in ZIKV. ZIKV NS1 is also the location of an epitope motif which is mimics for the microcephaly associated protein, ASPM.

In a further set of embodiments in the present invention we describe the epitopes and mimics thereof found in the structural proteins of Usutu virus, including envelope, PrM and capsid proteins.

In each of the cases where a potentially deleterious mimic occurs, it is desirable to avoid inclusion of a mimic epitope in a vaccine and thus we provide embodiments of vaccine constructs in which mimic epitopes have been deleted or mutated. In some embodiments, the mutation is a deletion mutation that removes all or part of the epitope mimic so that the polypeptide utilized in the vaccine does not cross react with antibodies specific for the wild type epitope mimic. In some embodiments, mutation is a substitution mutation or insertion mutation that alters the epitope mimic so that the polypeptide used in the vaccine does not cross react with antibodies specific for the wild type epitope mimic.

In some embodiments, the vaccine protein embodied in this invention may be expressed in a mammalian cell line, harvested, and delivered directly to the subject. In yet other embodiments, the vaccine polypeptide may be incorporated into a particular delivery vehicle, including but not limited to, a nanoparticle or virus like particle. In yet other embodiments, a ZIKV protein, engineered to delete or mutate epitope mimics may be incorporated as a chimera or pseudotype into a live virus vaccine where other proteins are derived from a heterologous flavivirus. In some particular embodiments, said heterologous flavivirus may be a yellow fever vaccine strain. In alternative embodiments, a viral vector, such as an adenoviral or poxvirus vector, may be used to deliver the synthetic vaccinal polypeptide. In yet other embodiments other modes of expression of the virus polypeptide are used which in some embodiments includes expression in a prokaryotic system. Those skilled in the art will be well aware of many alternative vaccine delivery vehicles as well as pharmaceutical compositions comprising adjuvants, so the above is not considered limiting.

In the present invention, we provide examples of constructs suitable for expression in mammalian cell lines of polypeptides as are described above. In assembling vector constructs for the expression of proteins and polypeptides, the skilled artisan has many options for choices of linkers of fusion partners, restriction sites for cloning, purification tags, cleavage sites, and in the case of immunoglobulin fusions, choices in the isotype and species of immunoglobulin. It will therefore be understood that the particular constructs provide examples of sequences which may be used to implement the inventions and are not to be considered limiting, as other combinations of all of these components many be equally effective and desirable. In some embodiments, we describe use of mouse immunoglobulin as a fusion partner, in others we describe human. In the examples shown, we adopt an enterokinase cleavage site to release standalone polypeptides; other cleavage sites including, but not limited to, a Factor Xa site, a serine glycine chain and many other possible linkers and cleavable linkers may be used. His tags are included to facilitate purification; but the same polypeptides may be produced without a histag or with a different purification tag.

In some embodiments, vaccines comprise peptides (e.g., those described herein). In some embodiments, vaccines are DNA vaccines comprising naked DNA encoding the peptides described herein or vectors or viral particles comprising nucleic acids encoding the peptides.

As used herein, the term "vaccine" refers to any combination of nucleic acid, peptides or single peptide formulation. There are various reasons why one might wish to administer a vaccine of a combination of the nucleic acids or peptides of the present invention rather than a single peptide. Depending on the particular peptide that one uses, a vaccine might have superior characteristics as far as clinical efficacy, solubility, absorption, stability, toxicity and patient acceptability are concerned. It should be readily apparent to one of ordinary skill in the art how one can formulate a vaccine of any of a number of combinations of peptides of the present invention. There are many strategies for doing so, any one of which may be implemented by routine experimentation.

In some embodiments, provided herein is a subunit vaccine comprising a flaviruses peptide or polypeptide described herein (e.g., a peptide described herein or a portion or variant thereof). A subunit vaccine presents an antigen to the immune system without introducing viral particles, whole or otherwise. In some embodiments, subunit vaccines are generated by recombinant expression of peptide using the methods described herein.

In some embodiments, DNA vaccines comprise nucleic acids encoding an epitope polypeptide described herein in a vector suitable for expression of the nucleic acid. In some embodiments, the nucleic acid is expressed in an expression cassette. In particular embodiments, the expression cassette is a eukaryotic expression cassette. The term "eukaryotic expression cassette" refers to an expression cassette which allows for expression of the open reading frame in a eukaryotic cell. A eukaryotic expression cassette comprises regulatory sequences that are able to control the expression of an open reading frame in a eukaryotic cell, preferably a promoter and polyadenylation signal. Promoters and polyadenylation signals included in the recombinant DNA molecules are selected to be functional within the cells of the subject to be immunized. Examples of suitable promoters, especially for the production of a DNA vaccine for humans, include but are not limited to promoters from cytomegalovirus (CMV), such as the strong CMV immediate early promoter, Simian virus 40 (SV40), Mouse Mammary Tumor Virus (MMTV), Human Immunodeficiency Virus (HIV), such as the HIF Long Terminal Repeat (LTR) promoter, Moloney virus, Epstein Barr Virus (EBV), and from Rous Sarcoma Virus (RSV) as well as promoters from human genes such as human actin, human myosin, human hemoglobin, human muscle creatine, and human metallothionein. In a particular embodiment, the eukaryotic expression cassette contains the CMV promoter. In the context of the present invention, the term "CMV promoter" refers to the strong immediate-early cytomegalovirus promoter.

Examples of suitable polyadenylation signals, especially for the production of a DNA vaccine for humans, include but are not limited to the bovine growth hormone (BGH) polyadenylation site, SV40 polyadenylation signals and LTR polyadenylation signals.

Other elements can also be included in the recombinant DNA molecule. Such additional elements include enhancers. The enhancer can be, for example, the enhancer of human actin, human myosin, human hemoglobin, human muscle creatine and viral enhancers such as those from CMV, RSV and EBV.

Regulatory sequences and codons are generally species dependent, so in order to maximize protein production, the regulatory sequences and codons are preferably selected to be effective in the species to be immunized. The person skilled in the art can produce recombinant DNA molecules that are functional in a given subject species.

In some embodiments, vaccines are adenoviral vaccines (See e.g., Tatsis and Ertl, Mol Ther. 2004 October; 10(4): 616-29; herein incorporated by reference). Adenoviral vectors are attractive candidates for transfer of foreign genes for a number of reasons. The adenoviral genome is well characterized and comparatively easy to manipulate. Most adenoviruses cause mild diseases in immunocompetent human adults and by deletion of crucial regions of the viral genome the vectors can be rendered replication-defective, which increases their predictability and reduces unwanted side effects. Adenoviruses have a broad tropism infecting a variety of dividing and nondividing cells. They can be grown to high titers in tissue culture. They can be applied systemically as well as through mucosal surfaces and their relative thermostability facilitates their clinical use.

Thus far most efforts have focused on vectors derived from adenovirus of the human serotype 5 (AdHu5) for use as vaccines for humans, while bovine, porcine, and ovine adenoviruses have been explored for veterinary use. In some embodiments, the In some embodiments, vaccines comprise a live, attenuated chimeric flavivirus that comprises a Yellow Fever virus in which the pre-membrane and envelope proteins have been replaced with sequences of the peptides described herein. General methods for constructing and administering chimeric flaviviruses that can be used in the present invention are described in detail, for example, in U.S. patent application Ser. Nos. 09/007,664, 09/121,578 (issued as U.S. Pat. No. 6,962,708), and Ser. No. 09/452,638 issued as U.S. Pat. No. 6,696,281); International applications PCT/US98/03894 (WO 98/37911) and PCT/US00/32821 (WO 01/39802); and Chambers et al., J. Virol. 73:3095 3101, 1999, which are each incorporated by reference herein in their entirety.

In some embodiments, vaccines comprise Virus-like particles (VLPs), structures similar or identical to mature virions but lacking the viral genome.

The vaccines of the present invention may be administered as a single agent therapy or in addition to an established therapy. The appropriate dosage of the vaccines of the invention may depend on a variety of factors. Such factors may include, but are in no way limited to, a patient's physical characteristics (e.g., age, weight, sex), whether the compound is being used as single agent or adjuvant therapy, the type of WIC restriction of the patient, the progression (i.e., pathological state) of the infection or other epitope-sensitive condition, and other factors that may be recognized by one skilled in the art. In general, an epitope or combination of epitopes may be administered to a patient in an amount of from about 50 micrograms to about 5 mg; dosage in an amount of from about 50 micrograms to about 500 micrograms is especially preferred.

For example, in some embodiments, the polypeptides comprising one or more epitopes are conjugated or otherwise attached to a carrier protein. Suitable carrier proteins include, but are not limited to keyhole limpet hemocyanin, bovine serum albumin, ovalbumin, and thyroglobulin. In yet other embodiments the polypeptide may be fused to an Fc region of an immunoglobulin for delivery to a mucosal site bearing corresponding receptors.

One may administer a vaccine of the present invention by any suitable method, which may include, but is not limited to, systemic injections (e.g., subcutaneous injection, intradermal injection, intramuscular injection, intravenous infusion) mucosal administrations (e.g., nasal, ocular, oral, vaginal and anal formulations), topical administration (e.g., patch delivery), or by any other pharmacologically appropriate technique. Vaccination protocols using a spray, drop, aerosol, gel or sweet formulation are particularly attractive and may be also used. The vaccine may be administered for delivery at a particular time interval, or may be suitable for a single administration.

Vaccines of the invention may be prepared by combining at least one nucleic acid, virus, polypeptide, or peptide with a pharmaceutically acceptable liquid carrier, a finely divided solid carrier, or both. As used herein, "pharmaceutically acceptable carrier" refers to a carrier that is compatible with the other ingredients of the formulation and is not toxic to the subjects to whom it is administered. Suitable such carriers may include, for example, water, alcohols, natural or hardened oils and waxes, calcium and sodium carbonates, calcium phosphate, kaolin, talc, lactose, combinations thereof and any other suitable carrier as will be recognized by one of skill in the art. In a most preferred embodiment, the carrier is present in an amount of from about 10 uL (micro-Liter) to about 100 uL.

In some embodiments, the vaccine composition includes an adjuvant. Examples of adjuvants include, but are not limited to, mineral salts (e.g., aluminum hydroxide and aluminum or calcium phosphate gels); oil emulsions and surfactant based formulations (e.g., MF59 (microfluidized detergent stabilized oil-in-water emulsion), QS21 (purified saponin), Ribi Adjuvant Systems, AS02 [SBAS2] (oil-in-water emulsion+MPL+QS-21), Montanide ISA-51 and ISA-720 (stabilized water-in-oil emulsion); particulate adjuvants (e.g., virosomes (unilamellar liposomal vehicles incorporating influenza haemagluttinin), AS04 ([SBAS4] Al salt with MPL), ISCOMS (structured complex of saponins and lipids), polylactide co-glycolide (PLG); microbial derivatives (natural and synthetic), e.g., monophosphoryl lipid A (MPL), Detox (MPL+*M. phlei* cell wall skeleton), AGP [RC-529] (synthetic acylated monosaccharide), DC_Chol (lipoidal immunostimulators able to self organize into liposomes), OM-174 (lipid A derivative), CpG motifs (synthetic oligonucleotides containing immunostimulatory CpG motifs), modified LT and CT (genetically modified bacterial toxins to provide non-toxic adjuvant effects); endogenous human immunomodulators (e.g., hGM-CSF or hIL-12 (cytokines that can be administered either as protein or plasmid encoded), Immudaptin (C3d tandem array); and inert vehicles, such as gold particles. In various embodiments, vaccines according to the invention may be combined with one or more additional components that are typical of pharmaceutical formulations such as vaccines, and can be identified and incorporated into the compositions of the present invention by routine experimentation. Such additional components may include, but are in no way limited to, excipients such as the following: preservatives, such as ethyl-p-hydroxybenzoate; suspending agents such as methyl cellulose, tragacanth, and sodium alginate; wetting agents such as lecithin, polyoxyethylene stearate, and polyoxyethylene sorbitan mono-oleate; granulating and disintegrating agents such as starch and alginic acid; binding agents such as starch, gelatin, and acacia; lubricating agents such as magnesium stearate, stearic acid, and talc; flavoring and coloring agents; and any other excipient conventionally added to pharmaceutical formulations.

Further, in various embodiments, vaccines according to the invention may be combined with one or more of the group consisting of a vehicle, an additive, a pharmaceutical adjunct, a therapeutic compound or agent useful in the treatment of the desired disease, and combinations thereof.

Peptide and Peptidomimetic Drugs:

A further set of embodiments, enabled by the present invention, address the use of peptides or peptidomimetics to bind antibodies generated in response to Zika virus. In some embodiments, small peptides comprising the mimic motif are incorporated into a substrate over which plasma from a subject infected with Zika or dengue is passed and to which antibodies in the plasma bind. To achieve such substrate binding it may be useful to generate the peptides in fusion with a histag, FLAG tag or other tag known to those skilled in the art that facilitates binding to the substrate.

Diagnostics:

A critical need in managing the ZIKV epidemic is the provision of diagnostic tools to physicians to enable in clinic diagnosis and hence the appropriate counselling of pregnant women and rapid initiation of GBS treatment. A particular consideration is that ZIKV co-circulates in the environment with dengue virus as well as yellow fever, and a number of non flavivirus co-endemic pathogens such as chikungunya and *Plasmodium*. Differentiating both acute febrile disease, and diagnosing GBS, requires a diagnostic test that separates ZIKV from dengue, and also identifies those dengue infections, thought to be only dengue type 3, which could sporadically also lead to GBS. In a particular embodiment, therefore, an immunodiagnostic kit is described which will differentiate Zika and dengue, and also infections with strains of dengue which may result in GBS. A second consideration is that determining the duration of Zika antibodies may determine when it is safe for a woman to conceive without risk of teratogenic sequalae. In another embodiment, therefore, an epitope specific immunoassay kit is described which shows antibody responses to an array of one or more Zika epitopes. In some particularly preferred embodiments, the peptide, polypeptide and protein sequences described above are used as capture reagents in an immunoassay. The present invention encompasses use of the capture reagents in a wide variety of immunoassay formats, including, but not limited to, ELISAs, chip-based assays and arrays, bead-based assays, flow through assays and the like as are known in the art.

In one embodiment, the peptides identified as mimics are included in peptide arrays or presented as peptides for antibody binding within the context of the adjacent ZIKV sequences. In yet other embodiments a synthetic version of the neurologic target protein is incorporated in a diagnostic kit to enable demonstration of binding by antibodies to the mimic target.

In a further embodiment, the present invention addresses the need for epitope specific diagnosis, and the need to differentiate between infections with Zika virus, and serotypes of dengue virus and yellow fever. As USUV spreads into dengue and ZIKV endemic areas it will be further necessary to differentiate from this flavivirus infection. In yet another embodiment, peptides of USUV structural proteins, which may be incorporated into a diagnostic peptide array alongside peptides from other flaviviruses, thereby enabling a peptide based diagnostic kit that provides for differentiation between USUV as well as ZIKV, dengue, yellow fever, West Nile virus, other arboviruses such as chikungunya virus, and other coendemic pathogens is provided.

The present invention addresses diagnostic peptides derived from structural proteins, including envelope, capsid and PrM, and from non structural proteins, in particular but not limited to NS1 proteins, from ZIKV and other flaviviruses as further detailed below. In one embodiment of the present invention we address a peptide derived from the NS1 protein of each virus which can provide differentiation in detection of antibodies. By identifying high probability antibody binding peptides specific for each virus as a reagent for a diagnostic kit, the present invention enables differential serologic diagnosis based on epitopes of NS1 protein.

In particular embodiments the peptides identified may be coupled to an anchor peptide to facilitate their attachment to a substrate, such anchor peptides include, but are not limited to, a his tag or a Flag tag. In yet additional embodiments, the peptides of interest may be fused to a label peptide such as luciferase or green fluorescent protein. These examples of label and anchor peptides should not be considered limiting as other alternatives are well known to those skilled in the art.

A further diagnostic kit allows differentiation of Zika and related flaviviruses from other potentially co-endemic organisms such as, but not limited to Saint Louis Encephalitis virus, hepatitis C, Japanese encephalitis virus, parvovirus 19, enteroviruses, Ross River virus, Eastern equine encephalitis and *Plasmodium* spp.

Any suitable diagnostic method may be employed in practice of the present invention. In some embodiments, the assay is an immunoassay. Illustrative non-limiting examples of immunoassays include, but are not limited to: immunoprecipitation; Western blot; ELISA; immunohistochemistry; immunocytochemistry; flow cytometry; and, immuno-PCR. Polyclonal or monoclonal antibodies detectably labeled using various techniques known to those of ordinary skill in the art (e.g., colorimetric, fluorescent, chemiluminescent or radioactive) are suitable for use in the immunoassays. The assays may be singleplex assays or multiplex assays. In some embodiments, the peptides, polypeptides and proteins described herein are used as capture reagents in the assays, i.e., the peptides, polypeptides and proteins described herein are configured in the assay system to capture antibodies specific for antigens in the peptides, polypeptides and/or proteins form a biological sample such as a serum or blood sample from a subject suspected of being infected by a flavivirus. The binding of the antibody or antibodies from the biological sample is then detected by methods known in the art (e.g., detection with a labelled second antibody and other methods described herein).

In singleplex assays, an antigenic composition or capture reagent comprising one of the peptides described herein is utilized in the assay. In multiplex assays, a panel of antigenic compositions or capture reagents are utilized in the assay. In some embodiments, the panel comprises at least 2, 3, 5, 5, 6, 7, 8, 9, 10, 11, 12, 13, 14, 15, 16, 17, 18, 19, 20, 25, 30, 40, 50, 60, 70, 80, 90 or 100 or more of the peptides described herein.

In some embodiments, the capture reagent of antigenic composition is brought in contact with, and allowed to bind to, a solid support or carrier, such as nitrocellulose or polystyrene or any other solid support known in the art (see below), allowing the antigens to adsorb and become immobilized to the solid support. This immobilized antigen is then allowed to interact with the biological fluid sample which is being tested for the presence of anti-flavivirus antibodies, such that any antibodies in the sample will bind to the immobilized antigen. The support to which the antibody is now bound may then be washed with suitable buffers after which a detectably labeled binding partner for the antibody is introduced. The binding partner binds to the immobilized antibody. Detection of the label is a measure of the immobilized antibody. In some embodiments, the immunoassay of this invention may be a "two-site" or "sandwich" assay. The fluid containing the antibody being assayed is allowed to contact a solid support. After addition of the antigen(s), a quantity of detectably labeled soluble antibody is added to permit detection and/or quantitation of the ternary complex formed between solid-phase antibody, antigen, and labeled antibody. Sandwich assays are described by Wide, Radioimmune Assay Method, Kirkham et al, Eds., E. & S. Livingstone, Edinburgh, 1970, pp 199-206.

A preferred binding partner for these assays is an anti-immunoglobulin antibody ("second antibody") produced in a different species. Thus to detect a nonhuman primate antibody, a detectably labeled goat anti-simian immunoglobulin "second" antibody may be used. The solid phase support may then be washed with the buffer a second time to remove unbound antibody. The amount of bound label on the solid support may then be detected by conventional means appropriate to the type of label used (see below).

Such a "second antibody" may be specific for epitopes characteristic of a particular human immunoglobulin isotype, for example IgM, $IgG_1$, $IgG_{2a}$, IgA and the like, thus permitting identification of the isotype or isotypes of antibodies in the sample which are specific for the flavivirus antigen. Alternatively, the second antibody may be specific for an idiotype of the anti-flavivirus antibody of the sample.

As alternative binding partners for detection of the sample antibody, other known binding partners for human immunoglobulins may be used. Examples are the staphylococcal immunoglobulin binding proteins, the best known of which is protein A. Also intended is staphylococcal protein G, or a recombinant fusion protein between protein A and protein G. Protein G of group G and group C streptococci binds to the Fc portion of Ig molecules as well as to IgG Fab fragment at the $V_{H3}$ domain. Protein C of Peptococcus magnus binds to the Fab region of the immunoglobulin molecule. Any other microbial immunoglobulin binding proteins, for example from Streptococci, are also intended (for example, Langone, J. J., Adv. Immunol 32:157 (1982)).

In another embodiment of this invention, a biological fluid suspected of containing antibodies specific for a flavivirus antigen may be brought into contact with a solid support or carrier which is capable of immobilizing soluble proteins. The support may then be washed with suitable buffers followed by treatment with flavivirus antigen reagent, which may be detectably labeled. Bound antigen is then measured by measuring the immobilized detectable label. If the flavivirus antigen reagent is not directly detectably labeled, a second reagent comprising a detectably labeled binding partner for the flavivirus antigen, generally a second anti-flavivirus antibody such as a murine mAb, is allowed to bind to any immobilized antigen. The solid phase support may then be washed with buffer a second time to remove unbound antibody. The amount of bound label on said solid support may then be detected by conventional means.

By "solid phase support" or carrier is intended any support capable of binding a proteinaceous antigen or antibody molecules or other binding partners according to the present invention. Well-known supports, or carriers, include glass, polystyrene, polypropylene, polyethylene, polyvinylidene difluoride, dextran, nylon, magnetic beads, amylases, natural and modified celluloses, polyacrylamides, agaroses, and magnetite. The nature of the carrier can be either soluble to some extent or insoluble for the purposes of the present invention. The support material may have virtually any possible structural configuration so long as it is capable of binding to an antigen or antibody. Thus, the support configuration may be spherical, as in a bead, or cylindrical, as in the inside surface of a test tube, or the external surface of a rod. Alternatively, the surface may be flat such as a sheet, test strip, etc. Preferred supports include polystyrene beads, 96-well polystyrene microplates and test strips, all well-known in the art. Those skilled in the art will know many other suitable carriers for binding antibody or antigen, or will be able to ascertain the same by use of routine experimentation.

Using any of the assays described herein, those skilled in the art will be able to determine operative and optimal assay conditions for each determination by employing routine experimentation. Furthermore, other steps as washing, stirring, shaking, filtering and the like may be added to the assays as is customary or necessary for the particular situation.

In some embodiments, the present invention provides protein chip assays comprising one or more capture reagents or antigenic compositions comprising at least one the peptides described herein. In such an assay, the capture reagents or antigenic compositions are immobilized on a solid support such as a chip. In some embodiments, the protein chip assay utilizes a solid support coated with ultrathin or clear nitrocellulose. See, e.g., US PAT PUBL. 20090253586 and 20090075828, both of which are incorporated herein by reference in their entirety. In preferred embodiments, the capture reagents or antigenic compositions are arrayed on the solid support. In multiplexed assays, a panel of capture reagents or antigenic compositions as described above is arrayed on the solid support. See, e.g., US PAT PUBL. 20090253586 and 20090075828, both of which are incorporated herein by reference in their entirety. A sample from a subject is passed over the solid support. Bound antibodies from the sample are then detected using any suitable method. Other suitable protein chip assays are described, for example, in U.S. Pat. Nos. 6,197,599; 6,294,790 and US Patent Application US20010014461A1, each of which is herein incorporated by reference in its entirety).

In some embodiments, a cytometric bead array assay is used (Quantum Plex kit, Bangs Laboratories; Cytometric Bead Array kit, BD Biosciences). These systems allow for multiple analyte detection with small volume samples. In other embodiments, a LUMINEX bead assay is used. See, e.g., U.S. Pat. Nos. 6,916,661; 6,939,720; 7,141,431; 7,445,844; 7,465,540; 8,038,734; and 8,088,629, all of which are incorporated herein by reference in their entirety.

In some embodiments, the immunoassay used to detect an antibody specific for an flavivirus antigen according to the present invention is an enzyme-linked immunosorbent assay (ELISA) or more generically termed an enzyme immunoassay (EIA). In such assays, a detectable label bound to either an antibody-binding or antigen-binding reagent is an enzyme. When exposed to its substrate, this enzyme will react in such a manner as to produce a chemical moiety which can be detected, for example, by spectrophotometric, fluorometric or visual means. Enzymes which can be used to detectably label the reagents useful in the present invention include, but are not limited to, horseradish peroxidase, alkaline phosphatase, glucose oxidase, β-galactosidase, ribonuclease, urease, catalase, malate dehydrogenase, staphylococcal nuclease, asparaginase, delta-5-steroid isomerase, yeast alcohol dehydrogenase, α-glycerophosphate dehydrogenase, triose phosphate isomerase, glucose-6-phosphate dehydrogenase, glucoamylase and acetylcholinesterase. For descriptions of EIA procedures, see reference cited above or, additionally, Voller, A. et al., J. Clin. Pathol. 31:507-520 (1978); Butler, J. E., Meth. Enzymol. 73:482-523 (1981); Maggio, E. (ed.), Enzyme Immunoassay, CRC Press, Boca Raton, 1980.

In some embodiments, the immunoassay devices of the present invention permit the performance of relatively inexpensive, disposable, membrane-based assays for the visual identification of the presence (or absence) of an analyte in a liquid sample. Such devices are usually formatted as free-standing dipsticks (e.g., test strips) or as devices having some sort of housing. Typically, an immunoassay device of the present invention can be used with as little as about 200 μl of liquid sample, and detection of an analyte in the sample can (but need not) be complete within 2-5 minutes. In preferred embodiments, no ancillary instrumentation is required to perform such tests, and such devices easily can be used in clinics, laboratories, field locations, and the home even by inexperienced persons.

In some embodiments, the ELISA is an immunochromatographic "sandwich" assay. In general, sandwich immunochromatographic procedures call for mixing the sample that may contain the analyte to be assayed, for example, flavivirus antibodies, with an antigenic composition or capture reagent as described above. A detector reagent is utilized which is mobile and typically is linked to a label or another signaling reagent, such as dyed latex, a colloidal metal sol, or a radioisotope. This mixture is then applied to a chromatographic medium containing a band or zone of immobilized antigenic compositions that serve as antigens for flavivirus antibodies (i.e., the capture reagent). The chromatographic medium often is in the form of a strip that resembles a dipstick. When the complex of flavivirus antibody and the detector reagent reaches the zone of the immobilized capture antibody on the chromatographic medium, binding occurs and the detector reagent complex is localized at the zone. This indicates the presence of the molecule to be assayed. This technique can be used to obtain quantitative or semi-quantitative results. Examples of sandwich immunoassays performed on test strips are described in U.S. Pat. Nos. 4,168,146 and 4,366,241, each of which is incorporated herein by reference.

In other embodiments, the ELISA is a solid phase immunoassay device that provides sensitive detection of analytes in biological fluid samples. Solid phase immunoassay devices incorporate a solid support to which one member of a ligand-receptor pair, usually an antibody, antigen, or hapten, is bound. Common early forms of solid supports were plates, tubes, or beads of polystyrene, which were known from the fields of radioimmunoassay and enzyme immunoassay. More recently, a number of porous materials such as nylon, nitrocellulose, cellulose acetate, glass fibers, and other porous polymers have been employed as solid supports. In other common forms of membrane-based immunoassays, as typified by some home pregnancy and ovulation detection kits, a test strip (or dipstick) is "dipped" into a sample suspected of containing the subject analyte. Enzyme-labeled detector reagent is then added, either simultaneously or after an incubation period. The device next is washed and then inserted into a second solution containing a substrate for the enzyme. The enzyme label, if present, interacts with the substrate, causing the formation of colored products, which either deposit as a precipitate onto the solid phase or produce a visible color change in the substrate solution. EP-A 0 125 118 describes such a sandwich type dipstick immunoassay. EP-A 0 282 192 describes a dipstick device for use in competition type assays.

In other embodiments, the assay device of the present invention is a flow through immunoassay device. Flow-through immunoassay devices involve a capture reagent (such as an immunogenic composition comprising at least one of the peptides described herein) bound to a porous membrane or filter to which a liquid sample is added. As the liquid flows through the membrane, target analyte (such as an flavivirus antibody) binds to the capture reagent. The addition of sample is followed by (or made concurrent with) addition of detector reagent (e.g., labeled second antibody). Alternatively, the detector reagent may be placed on the membrane in a manner that permits the detector to mix with the sample and thereby label the analyte. The visual detection of detector reagent provides an indication of the presence of target analyte in the sample. Representative flow-through immunoassay devices are described in U.S. Pat. Nos. 4,246,339; 4,277,560; 4,632,901; 4,812,293; 4,920,046; and 5,279,935; and U.S. Patent Application Publication Nos. 20030049857 and 20040241876, all of which are incorporated by reference in their entirety. In some embodiments, the assay device is a migration assay device. Such devices usually incorporate within them reagents that have been attached to colored labels, thereby permitting visible detection of the assay results without addition of further substances. See, for example, U.S. Pat. No. 4,770,853; PCT Publication No. WO 88/08534 and European Patent No. EP-A 0 299 428, all of which are incorporated by reference in their entirety.

In some embodiments, the assay device is lateral flow assay device. There are a number of commercially available lateral flow type tests and patents disclosing methods for the detection of analytes. See, e.g., U.S. Pat. Nos. 5,229,073; 5,591,645; 4,168,146; 4,366,241; 4,855,240; 4,861,711; 4,703,017; 5,451,504; 5,451,507; 5,798,273; 6,001,658; and 5,120,643; European Patent No. 0296724; WO 97/06439; and WO 98/36278, all of which are incorporated herein by reference.

The lateral flow assay devices of the present invention include a strip of absorbent or porous material (such as a microporous membrane), which, in some instances, can be made of different substances each joined to the other in zones, which may be abutted and/or overlapped. In some examples, the absorbent strip can be fixed on a supporting non-interactive material (such as nonwoven polyester), for example, to provide increased rigidity to the strip. Zones within each strip may differentially contain the specific binding partner(s) and/or other reagents required for the detection and/or quantification of the particular analyte being tested for, for example, flavivirus antibodies. Thus these zones can be viewed as functional sectors or functional regions within the test device.

In some embodiments, a fluid sample (or a sample suspended in a fluid) is introduced to the strip at the proximal end of the strip, for instance by dipping or spotting. A sample is collected or obtained using methods well known to those skilled in the art. The sample containing the flavivirus antibodies to be detected may be obtained from any biological source. Examples of biological sources include blood serum, blood plasma, urine, spinal fluid, saliva, fermentation fluid, lymph fluid, tissue culture fluid and ascites fluid of a human or animal. The sample may be diluted, purified, concentrated, filtered, dissolved, suspended or otherwise manipulated prior to immunoassay to optimize the immunoassay results. The fluid migrates distally through all the functional regions of the strip. The final distribution of the fluid in the individual functional regions depends on the adsorptive capacity and the dimensions of the materials used.

In some embodiments, porous solid supports, such as nitrocellulose, described hereinabove are preferably in the form of sheets or strips. The thickness of such sheets or strips may vary within wide limits, for example, from about 0.01 to 0.5 mm, from about 0.02 to 0.45 mm, from about 0.05 to 0.3 mm, from about 0.075 to 0.25 mm, from about 0.1 to 0.2 mm, or from about 0.11 to 0.15 mm. The pore size of such sheets or strips may similarly vary within wide limits, for example from about 0.025 to 15 microns, or more specifically from about 0.1 to 3 microns; however, pore size is not intended to be a limiting factor in selection of the solid support. The flow rate of a solid support, where applicable, can also vary within wide limits, for example from about 12.5 to 90 sec/cm (i.e., 50 to 300 sec/4 cm), about 22.5 to 62.5 sec/cm (i.e., 90 to 250 sec/4 cm), about 25 to 62.5 sec/cm (i.e., 100 to 250 sec/4 cm), about 37.5 to 62.5 sec/cm (i.e., 150 to 250 sec/4 cm), or about 50 to 62.5 sec/cm (i.e., 200 to 250 sec/4 cm). In specific embodiments of devices described herein, the flow rate is about 62.5 sec/cm (i.e., 250 sec/4 cm). In other specific embodiments of devices described herein, the flow rate is about 37.5 sec/cm (i.e., 150 sec/4 cm).

In some embodiments, the assay devices include a detector reagent. The detector reagent provides a means to detect the formation of a complex between an analyte (such as an flavivirus antibody or antibodies) and a capture reagent (such as an antigenic composition as described above). A detector may be integrated into an immunoassay device (for example included in a conjugate pad, as described below), or may be applied to the device from an external source.

A detector may be a single reagent or a series of reagents that collectively serve the detection purpose. In some instances, a detector reagent is a labeled binding partner specific for the analyte. In other instances, a detector reagent collectively includes an unlabeled first binding partner specific for the analyte and a labeled second binding partner specific for the first binding partner and so forth. In each instance, a detector reagent specifically detects bound analyte of an analyte-capture reagent complex and, therefore, a detector reagent preferably does not substantially bind to or react with the capture reagent or other components localized in the analyte capture area. Such non-specific binding or reaction of a detector may provide a false positive result. Optionally, a detector reagent can specifically recognize a positive control molecule (such as a non-specific human IgG for a labeled Protein A detector, or a labeled Protein G detector, or a labeled anti-human Ab(Fc)) that is present in a secondary capture area.

The flow-through devices of the present invention comprise a capture reagent (e.g., antigenic composition as described above) immobilized on a solid support such as a microtiter plate or a membrane (such as, nitrocellulose, nylon, or PVDF). Characteristics of useful membrane have been previously described; however, it is useful to note that in a flow-through assay capillary rise is not a particularly important feature of a membrane as the sample moves vertically through the membrane rather than across it as in a lateral flow assay. In a simple representative format, the membrane of a flow-through device is placed in functional or physical contact with an absorbent layer (see, e.g., description of "absorbent pad" below), which acts as a reservoir to draw a fluid sample through the membrane. Optionally, following immobilization of a capture reagent, any remaining protein-binding sites on the membrane can be blocked (either before or concurrent with sample administration) to minimize nonspecific interactions.

In operation of a flow-through device, a fluid sample (such as a bodily fluid sample) is placed in contact with the membrane. Typically, a flow-through device also includes a sample application area (or reservoir) to receive and temporarily retain a fluid sample of a desired volume. The sample passes through the membrane matrix. In this process, an analyte in the sample (e.g., flavivirus antibody or antibodies) can specifically bind to the immobilized capture reagent. Where detection of an analyte-capture reagent complex is desired, a detector reagent (e.g., labeled Protein A, labeled second antibody) can be added with the sample or a solution containing a detector reagent can be added subsequent to application of the sample. If an analyte is specifically bound by capture reagent, a visual representative attributable to the particular detector reagent can be observed on the surface of the membrane. Optional wash steps can be added at any time in the process, for instance, following application of the sample, and/or following application of a detector reagent.

A lateral flow device is an analytical device comprising a test strip, through which flows a test sample fluid that is suspected of containing an analyte of interest. The test fluid and any suspended analyte can flow along the strip to a detection zone in which the analyte (if present) interacts with a capture agent and a detection agent to indicate a presence, absence and/or quantity of the analyte. Many lateral flow devices are one-step lateral flow assays in which a biological fluid is placed in a sample area on a bibulous strip (though, non-bibulous materials can be used, and rendered bibulous, e.g., by applying a surfactant to the material), and allowed to migrate along the strip until the liquid comes into contact with a specific binding partner that interacts with an analyte in the liquid. Once the analyte interacts with the binding partner, a signal (such as a fluorescent or otherwise visible dye) indicates that the interaction has occurred. Multiple discrete binding partners can be placed on the strip (for example in parallel lines) to detect multiple analytes in the liquid. The test strips can also incorporate control indicators, which provide a signal that the test has adequately been performed, even if a positive signal indicating the presence (or absence) of an analyte is not seen on the strip.

The construction and design of lateral flow devices is described, for example, in Millipore Corporation, A Short Guide Developing Immunochromatographic Test Strips, 2nd Edition, pp. 1-40, 1999, available by request at (800) 645-5476; and Schleicher & Schuell, Easy to Work with BioScience, Products and Protocols 2003, pp. 73-98, 2003, available by request at Schleicher & Schuell BioScience, Inc., 10 Optical Avenue, Keene, N.H. 03431, (603) 352-3810; both of which are incorporated herein by reference. Lateral flow devices have a wide variety of physical formats. Any physical format that supports and/or houses the basic components of a lateral flow device in the proper function relationship is contemplated by this disclosure.

In some embodiments, lateral flow devices of the present invention comprise an elongated housing containing a bibulous lateral flow strip that extends substantially the entire length of housing. In some embodiments, the lateral flow strip is divided into a proximal sample application pad positioned below a sample introduction port, an intermediate test result membrane, and a distal absorbent pad. The flow strip is interrupted by a conjugate pad that contains labeled conjugate (such labeled second antibody). A flow path along the strip passes from the proximal pad, through conjugate pad, into a test result membrane, for eventual collection in absorbent pad. Selective binding agents (such as the antigenic compositions described above) are positioned on a proximal test line in the test result membrane. A control line is provided in the test result membrane slightly distal to the test line. A fluid sample containing an analyte of interest, such as flavivirus antibody or antibodies, is applied to the sample pad through the sample introduction port. In some embodiments, the sample may be applied to the sample introduction port dropwise or by dipping the end of the device containing the sample introduction port into the sample. From the sample pad, the sample passes, for instance by capillary action, to the conjugate pad. In the conjugate pad, the analyte of interest may bind (or be bound by) a mobilized or mobilizable detector reagent. For example, an flavivirus antibody may bind to a labeled (e.g., gold-conjugated) detector reagent (such as a second antibody contained in the conjugate pad. The analyte complexed with the detector reagent may subsequently flow to the test result membrane where the complex may further interact with a capture reagent, such as an antigenic composition as described above, which is immobilized at the proximal test line. The formation of the immunocomplex between flavivirus antibody, labeled (e.g., gold-conjugated) detector reagent, and immobilized antigenic composition can be detected by the appearance of a visible line at the proximal test line, which results from the accumulation of the label (e.g., gold) in the localized region of the proximal test line. The control line may contain an immobilized, detector-reagent-specific binding partner, which can bind the detector reagent in the presence or absence of the analyte. Such binding at the control line indicates proper performance of the test, even in the absence of the analyte of interest.

The particular materials used in a particular lateral flow device will depend on a number of variables, including, for example, the analyte to be detected, the sample volume, the desired flow rate and others. In some embodiments, the sample pad receives the sample, and may serve to remove particulates from the sample. In some embodiments, the sample pad is cellulose. Sample pads may be treated with one or more release agents, such as buffers, salts, proteins, detergents, and surfactants. Such release agents may be useful, for example, to promote resolubilization of conjugate-pad constituents, and to block non-specific binding sites in other components of a lateral flow device, such as a nitrocellulose membrane. Representative release agents include, for example, trehalose or glucose (1%-5%), PVP or PVA (0.5%-2%), Tween 20 or Triton X-100 (0.1%-1%), casein (1%-2%), SDS (0.02%-5%), and PEG (0.02%-5%).

The conjugate pad holds a detector reagent. In some embodiments, a detector reagent may be applied externally, for example, from a developer bottle, in which case a lateral flow device need not contain a conjugate pad (see, for example, U.S. Pat. No. 4,740,468). Detector reagent(s) contained in a conjugate pad is typically released into solution upon application of the test sample. A conjugate pad may be treated with various substances to influence release of the detector reagent into solution. For example, the conjugate pad may be treated with PVA or PVP (0.5% to 2%) and/or Triton X-100 (0.5%). Other release agents include, without limitation, hydroxypropylmethyl cellulose, SDS, Brij and β-lactose.

The absorbent pad acts to increase the total volume of sample that enters the device. This increased volume can be useful, for example, to wash away unbound analyte from the membrane. Any of a variety of materials is useful to prepare an absorbent pad. In some device embodiments, an absorbent pad can be paper (i.e., cellulosic fibers). One of skill in the art may select a paper absorbent pad on the basis of, for example, its thickness, compressibility, manufacturability, and uniformity of bed volume. The volume uptake of an absorbent made may be adjusted by changing the dimensions (usually the length) of an absorbent pad.

A wide variety of detectable labels are useful with the assays described above in addition to the described enzymatic labels.

In another embodiment, the detectable label may be a gold or silver nanoparticle that can be enhanced with non-enzymatic silver deposition (SilverQuant™). Methods for detection with silver or gold nanoparticles are described in detail in U.S. Pat. No. 7,321,829, incorporated by reference herein its entirety, as well as in US PUBL. 20090253586, also incorporated herein by reference in its entirety.

In another embodiment, the detectable label may be a Proximity Ligation Assay (PLA) reagent. Proximity ligation assay (PLA) is an approach for protein quantitation that can use two different binder molecules (proximity probes) to bind to a specific detection target (See for example Fredriksson, S. et al., Nat Biotechnol. 2002; 20(5): 473-77, Gullberg, M., et. al., Proc Natl Acad Sci USA. 2004; 101(22): 8420-24, Gullberg, M., et. al., Curr Opin Biotechnol. 2003; 14: 1-5, Pai, S., Ellington, A. D. and Levy, M., Nuc Acids Res. Oct. 19, 2005; 33(18): e162, Landegren, U. and Fredriksson, S., US Patent Application 20020064779, May 30, 2002, Fredriksson, S., US Patent Application 20050003361, all of which are incorporated by reference herein in their entirety. Typical binders include polyclonal or monoclonal antibody pairs. Each binder molecule can be conjugated to a specific oligonucleotide. One binder's oligonucleotide can form the "left" side of a real-time PCR amplicon, while the other binder can form the "right" side. When the two binders find and attach to the same target, the left and right oligomers are brought into close proximity. With the addition of a connector oligonucleotide (splint) and ligase enzyme, the left and right oligomers can become ligated and thereby allow for the formation of a complete target for a real-time PCR. Further addition of Taqman reaction components followed by thermocycling generates real-time sequence detection data output.

In another embodiment, the detectable label may be a radiolabel, and the assay termed a radioimmunoassay (MA), as is well known in the art. The radioisotope can be detected by a gamma counter, a scintillation counter or by autoradiography. Isotopes which are particularly useful for the purpose of the present invention are $^{125}I$, $^{131}I$, $^{35}S$, $^{3}H$ and $^{14}C$.

It is also possible to label the antigen or antibody reagents with a fluorophore. When the fluorescently labeled antibody is exposed to light of the proper wave length, its presence can then be detected due to fluorescence of the fluorophore. Among the most commonly used fluorophores are fluorescein isothiocyanate, rhodamine, phycoerythrin, phycocyanin, allophycocyanin, o-phthaldehyde, fluorescamine or fluorescence-emitting metals such as $^{152}Eu$ or other lanthanides. These metals are attached to antibodies using metal chelators.

The antigen or antibody reagents useful in the present invention also can be detectably labeled by coupling to a chemiluminescent compound. The presence of a chemiluminescent-tagged antibody or antigen is then determined by detecting the luminescence that arises during the course of a chemical reaction. Examples of useful chemiluminescent labeling compounds are luminol, isoluminol, theromatic acridinium ester, imidazole, acridinium salt and oxalate ester. Likewise, a bioluminescent compound such as a bioluminescent protein may be used to label the antigen or antibody reagent useful in the present invention. Binding is measured by detecting the luminescence. Useful bioluminescent compounds include luciferin, luciferase and aequorin.

Detection of the detectably labeled reagent according to the present invention may be accomplished by a scintillation counter, for example, if the detectable label is a radioactive gamma emitter, or by a fluorometer, for example, if the label is a fluorophore. In the case of an enzyme label, the detection is accomplished by colorimetry to measure the colored product produced by conversion of a chromogenic substrate by the enzyme. Detection may also be accomplished by visual comparison of the colored product of the enzymatic reaction in comparison with appropriate standards or controls.

In some embodiments, the one or more of the peptides or conjugates described above (alone or in combination) are used as an antigen stimulation mixture for cell based assays including, but not limited to, cytokine release assays (particularly interferon gamma release and interleukin 12) as measured by ELISA, Elispot, or bead based methods. In other embodiments, the peptides or conjugates described above (alone or in combination) are used in T-cell capture assays. In still other embodiments, the peptides or conjugates described above (alone or in combination) are used as an antigenic substitute for tuberculin in the tuberculin skin test (TST).

Immunovigilance:

In a different embodiment of the present invention, the mapping of specific B cell and T cell epitopes is important to managing and understanding the Zika epidemic spread. The recognition that minor amino acid changes can generate novel epitope mimics means that ongoing vigilance the virus is needed to determine if any new epitope characteristics appear or disappear. This can be done by comparison of sequences for the location of B and T cell epitopes and the absence of possibly suppressive T cell motifs. By hierarchical clustering of sequences with those collected to date any new immunological outliers can be detected. It will be appreciated that for an infection whose primary clinical manifestation is autoimmune, rapid detection of new or changing epitopes is of the upmost importance.

In some embodiments, the present invention provides linkage of epitope mimics to intrauterine pathology. In some embodiments, the present invention provides epitopes that find use in research applications (e.g., to further understanding of pathology of GBS).

Surrogate Markers and Diagnostics:

The clinical manifestations of Zika infection include neuropathologies that may be detected some-time after the initial viral infection. This includes GBS and other neural deficits detected in the weeks following acute infection. It also includes the array of teratologic neural abnormalities referred to as Zika fetal syndrome, which only become apparent on ultrasound or on the birth of the child. It is likely that further consequences of Zika fetal syndrome are detected as the children infected in utero grow up. This is the case in rubella infections. Given the delay to detection of such signs it is useful to have an indicator which can anticipate which individuals may be affected. Detection of antibodies to the human neurologic proteins bearing the mimics provides such a surrogate marker or indicator. Therefore, one embodiment of the present invention is the provision of synthetic versions of the neurologic proteins and control versions of the same in which the mimic motifs have been mutated or replaced. This enables the determination of antibodies which bind to the mimic epitopes of concern. Such synthetic polypeptides may be derived from NPY or from NAV2 or from any other human protein which carries a mimic with which anti Zika antibodies react. Such synthetic polypeptides may be included in an assay format for detection of serum antibodies. The assay format may be any format known to those skilled in the art including but not limited to Western blots, ELISA, gel diffusion, dot blots or others.

Endemnicity of Zika Compared to Malaria:

In conducting a bioinformatics analysis of ZIKV and other closely related flaviviruses to identify peptides that are B cell epitopes which may serve in differential diagnosis between the co-endemic flaviviruses, we also examined the potential cross reactivity with other pathogens. A high degree of B cell epitope identity with *Plasmodium falciparum* was noted indicative of probable cross reactivity. This was found in both envelope and NS1 proteins and was identified as to the specific sequences which have matching B cell epitopes, as further described in the Examples. When a similar comparison was conducted for *P.vivax* a similar number of potential cross reactive B cell epitopes was identified, in different proteins from those identified in *P. falciparum*. Particularly noticeable in the case of the B cell epitope matches between ZIKV and *P falciparum* was that *P falciparum* B cell epitopes occurred in erythrocyte and liver stage antigens of the malaria parasite, some of which are under investigation as potential malaria vaccines [45]. The presence of cross reactions between Zika NS1 and malaria was noted in a comment in Eurosurveillance [46] as a potential complication in interpretation of the Euroimmun diagnostic test.

A comparison of the maps of *P. falciparum* distribution both in Brazil and globally makes abundantly clear that severe Zika disease is occurring where malaria is absent (FIG. 4). Both malaria and ZIKV are transmitted by *Aedes* mosquitoes. A similar, but less exact, pattern of overlap occurs with *P vivax*. Where malaria is present, severe cases of Zika are not reported. This includes Haiti and the Dominican Republic. Conversely malaria is absent from Martinique. Comparison of the distribution of malaria and Zika in Colombia based on the weekly health statistics bulletin (Boletín Epidemiológico Semanal Number 27, 3 Jul. 2016) shows also that departments where malaria transmission is active (primarily on the Pacific coast) have the lowest incidence of Zika, which is most prevalent in the low malaria north eastern Atlantic coastal region. GBS cases have been reported disproportionately on the northern Atlantic coast of Colombia [25].

B cell epitopes are bound by B cell receptors and by specific antibody variable regions. Recent work has determined that the binding of an antibody variable region or B cell receptor depends on a span of five amino acids [47]. The strategy developed and demonstrated herein for identifying B cell epitopes shared between Zika and other flaviviruses and *Plasmodium* therefore depends on identifying identical pentamers located in high probability B cell binding sequences. The probability of occurrence of any one B cell pentamer occurring in a protein is $20^5$ or 1 in 3.2 million possible pentamer configurations. Thus, finding a matching pentamer in two independent proteins is 3.2 million×3.2 million or 1 in $10^{12}$. In one particular embodiment, a hexamer peptide B cell epitope of the liver specific protein of *P. falciparum* (Pf3D7_1418100 LISP) matches a B cell epitope in the DE loop of Envelope domain III of Zika virus. A hexamer match is a rare chance of 4 in $10^{15}$. This Zika loop coincides with the protective epitope previously identified [48]. Another such hexamer match is found in the Domain 1 Zika envelope protein with PF3D7_1408700 conserved *Plasmodium* protein.

In one series of embodiments of the present invention, therefore, we identify B cell epitopes of malaria proteins which are identical with B cell epitopes of Zika virus. Some of these correspond to epitopes on Zika envelope identified herein as eliciting protective antibodies and subsequently confirmed by others [48] and which can therefore provide cross protection. In some particular embodiments, these epitopes are in *Plasmodium falciparum* proteins; in yet others they are in *P. vivax* proteins. Another embodiment arising from this is a vaccine which comprises polypeptides or peptides from *Plasmodium* as an immunogen component of a vaccine intended to protect from Zika infection and/or disease.

A concern with Zika disease is that the GBS autoimmune disease and other manifestations of clinical disease such as thrombocytopenia [39] may be driven by antibodies to epitope mimics matching human proteome proteins. A particular advantage of the use of malaria peptides and polypeptides is that they may offer protection, while not simultaneously providing flanking peptides which may elicit autoimmune antibodies. In one embodiment of the present invention we identify malaria peptides which avoid particular epitope mimics in the human proteome and provide compositions for use as ZIKV preventive vaccines.

A further concern in flavivirus pathology is that sub neutralizing antibodies have been linked to enhanced virus titers on exposure to a second related flavivirus infection. This occurs between two dengue infections of different serotypes and between dengue and ZIKV [37]. Much of the ADE has been traced to a region of the envelope protein known as the fusion loop [4] forming the tip of the Domain 2 of the envelope. A peptide sequence DRGWGN (SEQ ID NO.: 1259) that contributes to this epitope in flaviviruses is absent from *Plasmodium falciparum* and *P. vivax*. This provides the opportunity, in one embodiment herein, to define immunogenic peptides or polypeptides of malaria proteins which avoid causing ADE. In yet another embodiment it allows differential diagnosis of flavivirus infections from malaria, given the absence from *Plasmodium* of the peptide motifs in flavivirus fusion loop which generate cross reactive antibodies common to dengue, ZIKV and Yellow fever. The two safety features cited above, avoidance of autoimmune mimics and ADE, are of particular importance in designing a vaccine.

In a further set of embodiments of the present invention, we identify a diagnostic strategy which considers the cross reactivity of *Plasmodium* in design of a diagnostic kit for Zika.

While the specific examples that follow in relation to *Plasmodium* mimics apply initially to Zika this is not intended to be restrictive as a similar overlap of B cell epitopes is identified for dengue and yellow fever and in further embodiments will allow design of vaccine polypeptides and peptides and diagnostic strategies for these flaviviruses also.

B Cell Elimination:

The adverse effects resulting from antibodies from Zika virus exposure which are directed to a human neurologic protein, or from dengue exposure, which are directed to a mimic epitope matching an epitope in a human protein of cardiovascular function, or indeed from autoimmune antibodies arising from any flavivirus exposure, may be mitigated by prior vaccination with a vaccine in which the epitopes of interest are mutated, or the antibodies may be reduced by plasmapheresis. During plasmapheresis, blood (which consists of blood cells and a clear liquid called plasma) is initially taken out of the body through a needle or previously implanted catheter. Plasma is then removed from the blood by a cell separator. In order to remove autoantibodies to Zika epitopes, blood plasma is removed and exchanged with blood products to be donated to the recipient. This type of plasmapheresis is called plasma exchange (PE or PEX) or plasma exchange therapy (PET). The removed plasma is discarded and the patient receives replacement donor plasma, albumin, or a combination of albumin and saline (usually 70% albumin and 30% saline). In some embodiments, auto-antibodies are removed from the isolated plasma by filtration on a specific substrate (e.g., comprising a peptide described herein). In some embodiments, a column is attached to the plasma line, selectively eliminating the pathogenic autoantibody and returning the patient's own plasma. Any suitable substrate may be utilized in plasmapheresis (e.g., particle, bead, filter, resin, etc.)

However, a concern remains that as long as the B cell clonal populations which secrete the mimic-binding antibodies remain in the body, they may continue to secrete the antibodies and the clonal populations may expand again on re-exposure to the virus. In these circumstances, it may be useful to abrogate those B cell clonal lines which are generating the antibodies specific for these mimic epitopes. This can be achieved by "baiting" the B cells with the epitope mimic peptides fused to a cytocide or cytotoxin, so that as B cells specifically bind and incorporate the peptide they are also specifically exposed to the lethal cytocide or cytotoxin, many of which are known to those skilled in the art but which include RNAses (e.g., RNase A, RNase H, RNase III, RNase L, RNase P, RNase PhyM, RNase T1, RNase T2, RNase U2, and RNase V i), membrane active peptides (e.g., amyloid peptides, antimicrobial peptides, and cell-penetrating peptides), and diphtheria toxin. See also, WO 2010/083225, herein incorporated by reference in its entirety. Cytotoxins may also include radioactive alpha emitters or auger particles. In a particular embodiment herein therefore, the epitope peptide identified in the flavivirus is operatively linked to a cytotoxin or cytocide and administered to an affected subject.

EXPERIMENTAL

The following examples are provided in order to demonstrate and further illustrate certain preferred embodiments and aspects of the present invention and are not to be construed as limiting the scope thereof.

Example 1

Identification of Epitopes Unique to American Zika Virus and Comparison to Dengue and Yellow Fever.

Rapid immunoinformatic analysis of the envelope protein of Zika, from ZikaSPH2015 (KU321639), indicates predicted B and T cell epitopes in peptides that are structurally consistent to those reported for dengue, YF and JEV (FIG. 5). The envelope protein Domain II B cell epitope DRGWGNG (SEQ ID NO.: 1260) at 97-103 aa position, to which much dengue non-neutralizing cross reaction is attributed [4], is conserved also in ZIKV, consistent with prior field observations of cross reactivity with dengue and YF. This B cell epitope overlaps a conserved T cell exposed motif (G~~G~G~LV) (SEQ ID NO.: 1261) shared by ZIKV and dengue virus 3, which is predicted to be bound at high affinity by DQ alleles. This is a common immunoglobulin-like MHC II motif is present in 1 in 64 antibody variable regions [49]. Domain III of Zika, likely the main neutralizing domain, is distinct from recent Brazilian dengue isolates. When compared with recent Brazilian dengue 1-4 isolates (GQ330473, HQ184924, JF808120, JN848496, JQ513335, KP858105, KP858119, HQ184925, JN848499, KP858111) and a recent Peruvian YF isolate (GQ379163), 76% of possible MHCI and MHC II binding peptides are unique to ZIKV. Related to this, the patterns of similarity of T and B cell motifs with the human proteome differs in ZIKV, indicating a potentially different pattern of epitope mimics from dengue. Analysis of these motifs identified proteins of the human proteome critical to neurologic development which share pentamer motifs with ZIKV. When envelopes of 35 strains of Zika from around the world are compared [19, 50], the Cook Island and Brazilian isolates stand apart from two clusters of African isolates, based on analysis of B cell linear epitopes and predicted MHC II binding (FIG. 6).

Example 2 Identification of Epitope Mimics in Zika Virus Structural Proteins Following computation of master matrices of B cell and MHC binding predictions as previously described (PCT US2011/029192, PCT US2012/055038, and US2014/01452, each of which is incorporated herein by reference) a subset of peptides was identified which has predicted binding to B cell epitopes in the top 25%, i.e. those with binding of less than −0.6 standard deviation units below the mean for the protein. Peptides selected were pentamers, which is a conservative filter as B cells may bind to as few as 3 amino acids. This set of pentamers was joined to a precomputed database of pentamers in the human proteome (over 33 million peptides). This was in turn compiled with a list of Uniprot identities. The resulting subset of ~2700 proteins was manually curated and searched using a key term search for proteins curated as containing "neur" "glial" and "synap". A subset of proteins with neural function and match of pentamers to Zika B cell epitopes was thus arrived at Table 1.

TABLE 1

| | Pentamer motif | Protein ID in Human proteome | Other flavi? | Zika Env aa position |
|---|---|---|---|---|
| SEQ 1 | PVITE | E7EMY4_HUMAN Neural cell adhesion molecule L1 (Fra | 0 | 364 |
| SEQ 2 | EGAVH | E7EP46_HUMAN Neurotrophin-4 OS = *Homo sapiens* | 0 | 263 |

TABLE 1-continued

| | Pentamer motif | Protein ID in Human proteome | Other flavi? | Zika Env aa position |
|---|---|---|---|---|
| SEQ 3 | STENS | E7EP46_HUMAN Neurotrophin-4 OS = *Homo sapiens* | 0 | 369 |
| SEQ 4 | PVITE | E7EPI4_HUMAN Neural cell adhesion molecule L1 (Fra | 0 | 364 |
| SEQ 5 | PVITE | E7EVM4_HUMAN Neural cell adhesion molecule L1 (Fra | 0 | 364 |
| SEQ 6 | PVITE | E9PHJ4_HUMAN Neural cell adhesion molecule L1 (Fra | 0 | 364 |
| SEQ 7 | KGRLS | E9PNV5_HUMAN Neuron navigator 2 (Fragment) | 1 | 282 |
| SEQ 8 | PVITE | F5H025_HUMAN Neural cell adhesion molecule L1 | 1 | 364 |
| SEQ 9 | PVITE | F5H1H0_HUMAN Neural cell adhesion molecule L1 | 1 | 364 |
| SEQ 10 | PVITE | L1CAM_HUMAN Isoform 2 of Neural cell adhesion mole | 1 | 364 |
| SEQ 11 | PVITE | L1CAM_HUMAN Isoform 3 of Neural cell adhesion mole | 1 | 364 |
| SEQ 12 | PVITE | L1CAM_HUMAN Neural cell adhesion molecule L1 | 1 | 364 |
| SEQ 13 | AGADT | M0QX38_HUMAN Neurogenic locus notch homolog | 1 | 228 |
| SEQ 14 | KGRLS | NAV2_HUMAN Isoform 10 of Neuron navigator 2 | 1 | 282 |
| SEQ 15 | KGRLS | NAV2_HUMAN Isoform 11 of Neuron navigator 2 | 1 | 282 |
| SEQ 16 | KGRLS | NAV2_HUMAN Isoform 12 of Neuron navigator 2 | 1 | 282 |
| SEQ 17 | KGRLS | NAV2_HUMAN Isoform 13 of Neuron navigator 2 | 1 | 282 |
| SEQ 18 | KGRLS | NAV2_HUMAN Isoform 2 of Neuron navigator 2 | 1 | 282 |
| SEQ 19 | KGRLS | NAV2_HUMAN Isoform 3 of Neuron navigator 2 | 1 | 282 |
| SEQ 20 | KGRLS | NAV2_HUMAN Isoform 4 of Neuron navigator 2 | 1 | 282 |
| SEQ 21 | KGRLS | NAV2_HUMAN Isoform 5 of Neuron navigator 2 | 1 | 282 |
| SEQ 22 | KGRLS | NAV2_HUMAN Isoform 8 of Neuron navigator 2 | 1 | 282 |
| SEQ 23 | KGRLS | NAV2_HUMAN Isoform 9 of Neuron navigator 2 | 1 | 282 |
| SEQ 24 | KGRLS | NAV2_HUMAN Neuron navigator 2 OS = *Homo sapiens* | 1 | 282 |
| SEQ 25 | ATLGG | NCAM1_HUMAN Isoform 3 of Neural cell adhesion mol | 0 | 179 |
| SEQ 26 | ATLGG | NCAM1_HUMAN Isoform 4 of Neural cell adhesion mol | 0 | 179 |
| SEQ 27 | LSSGH | NDF4_HUMAN Neurogenic differentiation factor 4 OS = | 0 | 285 |
| SEQ 28 | GGALN | NOTC1_HUMAN Neurogenic locus notch homolog | 1 | 436 |
| SEQ 29 | QPENL | NOTC2_HUMAN Neurogenic locus notch homolog | 0 | 132 |
| SEQ 30 | AGADT | NOTC3_HUMAN Neurogenic locus notch homolog | 1 | 228 |
| SEQ 31 | ESTEN | NPY_HUMAN Pro-neuropeptide Y OS = *Homo sapiens* | 1 | 368 |
| SEQ 32 | AGTDG | NUFP2_HUMAN Nuclear fragile X mental retardation-i | 0 | 230 |
| SEQ 33 | ATLGG | R4GMN9_HUMAN Neural cell adhesion molecule 1 | 0 | 179 |
| SEQ 34 | RAEAT | SNP29_HUMAN Synaptosomal-associated protein 29 | 0 | 176 |

Column 3 indicates whether the same protein (by different motifs) is matched in other flaviruses, 1 = yes The same process was repeated for the envelopes of 18 flaviviruses comprising those shown in Table 2 which includes 15 non Zika viruses.

TABLE 2

| Flavivirus | Gi or accession number |
|---|---|
| Zika - SPH2015 Brazil | 969945757 |
| Zika - Cook Islands 631250743 | 631250743 |
| Zika - ArD158084 Senegal | 592746966 |
| Dengue 3 and 4 (2 each) recent wildtypes from Brazil | GQ330473 JF808120 JN848496 JQ513335 |
| Dengue 1 and 2 (2 each, partial env) recent wildtypes from Brazil | HQ184924 KP858105 KP858119 HQ184925 |
| Yellow fever - 2007 Peru wildtype isolate | GQ379163 |
| YF 17D vaccine strain | 130490 |
| Dengue 1 and 2 reference strains (not South American) | 119364637 and 266813 |
| WNV | 37999909 |
| JEV | 130490 |
| TBEV | 6226885 |

In addition to identifying neural matches, a comparison of pentamer usage among the 18 flavivirus envelopes confirmed that of 8505 unique pentamers, 1144 were found exclusively in the 3 Zika viruses and that the distribution of unique motifs was as shown in Table 3 and the sharing patterns are shown in FIG. 7.

TABLE 3

| Unique pentamer | Zika Senegal | Zika Cook Is | Zika Brazil |
|---|---|---|---|
| 329 | + | + | + |
| 45 | + | − | − |
| 48 | − | + | + |
| 5 | − | − | + |

Isolate identities as in Table 2

Among the flaviviruses that are not Zika viruses, additional neural matches were found as shown in Table 4. Some pentamer matches occurred in multiple flaviviruses (score not shown in Table 4)

TABLE 4

| | pentamer | Human protein id |
|---|---|---|
| SEQ 35 | AGADT | M0QX38_HUMAN Neurogenic locus notch, homolog protein |
| SEQ 36 | AGADT | NOTC3_HUMAN Neurogenic locus notch homolog protein |
| SEQ 37 | DGSPC | NOTC3_HUMAN Neurogenic locus notch homolog protein |
| SEQ 38 | GEDAP | NPY_HUMAN Pro-neuropeptide Y OS = *Homo sapiens* GN = NP |
| SEQ 39 | GNETT | F5H025_HUMAN Neural cell adhesion molecule L1 OS = H |
| SEQ 40 | GNETT | F5H1H0_HUMAN Neural cell adhesion molecule L1 OS = H |
| SEQ 41 | GNETT | L1CAM_HUMAN Isoform 2 of Neural cell adhesion mole |
| SEQ 42 | GNETT | L1CAM_HUMAN isoform 3 of Neural cell adhesion mole |
| SEQ 43 | GNETT | L1CAM_HUMAN Neural cell adhesion molecule L1 OS = Ho |
| SEQ 44 | KCPST | F5H804_HUMAN Nuclear protein MDM1 OS = *Homo sapiens* |
| SEQ 45 | KNPVD | F5H025_HUMAN Neural cell adhesion molecule L1 OS = H |
| SEQ 46 | KNPVD | F5H1H0_HUMAN Neural cell adhesion molecule L1 OS = H |
| SEQ 47 | KNPVD | L1CAM_HUMAN Isoform 2 of Neural cell adhesion mole |
| SEQ 48 | KNPVD | L1CAM_HUMAN Isoform 3 of Neural cell adhesion, mole |
| SEQ 49 | KNPVD | L1CAM_HUMAN Neural cell adhesion molecule L1 OS = Ho |
| SEQ 50 | LKGTT | NOTC1_HUMAN Neurogenic locus notch homolog protein |
| SEQ 51 | STTLK | F5H025_HUMAN Neural cell adhesion molecule L1 OS = H |
| SEQ 52 | STTLK | F5H1H0_HUMAN Neural cell adhesion molecule L1 OS = H |
| SEQ 53 | STTLK | L1CAM_HUMAN Isoform 2 of Neural cell adhesion mole |
| SEQ 54 | STTLK | L1CAM_HUMAN Isoform 3 of Neural cell adhesion mole |
| SEQ 55 | STTLK | L1CAM_HUMAN Neural cell adhesion molecule L1 OS = Ho |
| SEQ 56 | TDKEK | E9PNV5_HUMAN Neuron navigator 2 (Fragment) OS = Hom |
| SEQ 57 | TDKEK | NAV2_HUMAN Isoform 10 of Neuron navigator 2 OS = Hom |
| SEQ 58 | TDKEK | NAV2_HUMAN Isoform 11 of Neuron navigator 2 OS = Hom |
| SEQ 59 | TDKEK | NAV2_HUMAN Isoform 12 of Neuron navigator 2 OS = Hom |
| SEQ 60 | TDKEK | NAV2_HUMAN Isoform 13 of Neuron navigator 2 OS = Hom |

TABLE 4-continued

| pentamer | Human protein id |
|---|---|
| SEQ 61 TDKEK | NAV2_HUMAN Isoform 2 of Neuron navigator 2 OS = *Homo* |
| SEQ 62 TDKEK | NAV2_HUMAN Isoform 3 of Neuron navigator 2 OS = *Homo* |
| SEQ 63 TDKEK | NAV2_HUMAN Isoform 4 of Neuron navigator 2 OS = *Homo* |
| SEQ 64 TDKEK | NAV2_HUMAN Isoform 5 of Neuron navigator 2 OS = *Homo* |
| SEQ 65 TDKEK | NAV2_HUMAN Isoform 8 of Neuron navigator 2 OS = *Homo* |
| SEQ 66 TDKEK | NAV2_HUMAN Isoform 9 of Neuron navigator OS = *Homo* |
| SEQ 67 TDKEK | NAV2_HUMAN Neuron navigator 2 OS = *Homo sapiens* GN = N |
| SEQ 68 TPQAP | NAV2_HUMAN Isoform 10 of Neuron, navigator 2 OS = Hom |
| SEQ 69 TPQAP | NAV2_HUMAN Isoform 11 of Neuron navigator 2 OS = Hom |
| SEQ 70 TPQAP | NAV2_HUMAN Isoform 12 of Neuron navigator 2 OS = Hom |
| SEQ 71 TPQAP | NAV2_HUMAN Isoform 13 of Neuron navigator 2 OS = Hom |
| SEQ 72 TPQAP | NAV2_HUMAN Isoform 2 of Neuron navigator 2 OS = *Homo* |
| SEQ 73 TPQAP | NAV2_HUMAN Isoform 3 of Neuron navigator 2 OS = *Homo* |
| SEQ 74 TPQAP | NAV2_HUMAN Isoform 4 of Neuron navigator 2 OS = *Homo* |
| SEQ 75 TPQAP | NAV2_HUMAN Isoform 8 of Neuron navigator 2 OS = *Homo* |
| SEQ 76 TPQAP | NAV2_HUMAN Isoform 9 of Neuron navigator 2 OS = *Homo* |
| SEQ 77 TPQAP | NAV2_HUMAN Neuron navigator 2 OS = *Homo sapiens* |

While there is considerable commonality between the proteins in which matches occur in ZIKVa vs other flaviviruses, the actual pentamers and their positions in both virus and target human protein was different. Each motif and the associated epitope context was examined in both source (virus) and target (human neural protein). Most consideration was given to those which match a B cell epitope in the target protein as well as a B cell epitope in the source. Each neural protein was mapped, as were the envelope proteins. The associated MEW binding in the source viral protein was reviewed as an indicator of how strong an antibody response may be stimulated due to more/lessT helper cells.

As an example of the findings, both dengue 3 and ZIKV have peptides which match a counterpart target motif in NPY. Coincidentally the dengue pentamer ~GEDAP~ (SEQ ID NO.: 38) is only found in dengue 3 isolates of >400 dengue isolates since 2005 from S America that we queried, not in other dengue types. The comparative features are shown in Table 5.

TABLE 5

| Virus | Virus pentamer motif | Virus Envelope position | BEPI strength in Source virus | MHC II in Source virus | NPY position | NPY Bepi? |
|---|---|---|---|---|---|---|
| Zika (all isolates) | ~ESTEN~ (SEQ ID NO: 31) | 368, Domain III loop5* | Moderate | Very Strong all DRB and DP and DQ alleles | Position 86 BEPI centerd at position 88 In CONAP C terminal peptide | yes |
| Dengue (only DEN3 | ~GEDAP~ (SEQ ID NO: 38) | 328, Domain III loop4* | Moderate | Weak except for DRB1: 0404 and DRB1: 1101 | Position 42, BEPI centered at 44. In helical mature peptide | Yes |

*envelope aa positions based on GenPep indications of regions in polyprotein.

FIG. 9 shows the epitope map of NPY, showing that the two pentamers are both in B cell epitopes but in different places. GDAP lies in the helical portion of NPY whereas ESTEN (SEQ ID NO.: 580) is in the CONAP C terminal section [51]. Both peptide segments of the propeptide are active in neural development and many functions including retinal health [52]. FIG. 8 shows the position in the envelope domain III based on the JEV structural model [12]. FIGS. 10 and 11 shows the position of the neural matched motifs in Den 3 and in Zika envelopes. We further checked the occurrence of pentamer ESTEN (SEQ ID NO.: 580) in other infectious agents via BLAST, finding no hits; peptide ESTEN (SEQ ID NO.: 580) is a useful marker for ZIKV.

Similar comparative analysis of other neural proteins indicates that those specific to ZIKV may also play a contributing role in the pathogenesis. In one case, the pentamer PVITE (SEQ ID NO.: 1) overlaps with ESTEN (SEQ ID NO.: 580) and benefits from the same strong T cell helper response. PVITE (SEQ ID NO.: 1) finds an epitope mimic in LCAM1 neural adhesion molecules.

One other area of the envelope sequence merited particular consideration as it was noted that the sequence with peptides initiating in positions 260-273 has a very high content of motifs with homologues in the human proteome. This region is a relatively weak B cell epitope. One neural match EGAVH (SEQ ID NO.: 2) was found for an epitope centered at position 263. However additional peptides in this region showed mimic-matches with Glial fibrillary acid protein (GFAP) and with Glycoprotein M6A (GPM6a), proteins with important roles in neural development. GFAP has been identified as a protein to which antibodies are found in the axonal form of GBS. and GPM6a plays a role in migration and differentiation of neurons. The corresponding pentamers are shown in Table 6

TABLE 6

| | |
|---|---|
| SEQ 78 LAGAL | GFAP_HUMAN Isoform 2 of Glial fibrillary acidic protein |
| SEQ 79 ALAGA | NEURONAL MEMBRANE GLYCOPROTEIN M6-a |

Mimics of other neural proteins are found in the ZIKV capsid and PrM protein as shown in Table 6. However, these proteins are in fewer copy numbers in each virion and are partly concealed to the B cells by the outer layer of envelope proteins, so are less likely candidates to play a role in autoimmune pathogenesis.

TABLE 7

| Capsid protein-pentamer BEPI motifs in Zika capsids unique to Zika vs other flaviviruses. | | |
|---|---|---|
| SEQ 80 | KKEAM | A3KFI4_HUMAN Neuroblastoma suppressor of tumorigen |
| SEQ 81 | KKEAM | A3KFI5_HUMAN Neuroblastoma suppressor of tumorigen |
| SEQ 82 | EAMEI | ESYT2_HUMAN Isoform 4 of Extended synaptotagmin-2 |
| SEQ 83 | EAMEI | ESYT2_HUMAN Isoform 5 of Extended synaptotagmin-2 |
| SEQ 84 | EAMEI | ESYT2_HUMAN Isoform 6 of Extended synaptotagmin-2 |
| SEQ 85 | EAMEI | ESYT3_HUMAN Extended synaptotagmin-3 OS = *Homo* sapie |
| SEQ 86 | EAMEI | ESYT3_HUMAN Isoform 2 of Extended synaptotagmin-3 |
| SEQ 87 | RKEKK | A6NCR3_HUMAN Synaptopodin 2-like protein |
| SEQ 88 | RKEKK | A6NCR4_HUMAN Synaptotagmin-8 OS = *Homo sapiens* |
| SEQ 89 | RKEKK | NBPFL_HUMAN Neuroblastoma breakpoint family member |
| SEQ 90 | KEKKR | A2BH96_HUMAN Neuroblastoma breakpoint family member |
| SEQ 91 | KEKKR | A3KFI1_HUMAN Neuroblastoma suppressor of tumorigen |
| SEQ 92 | KEKKR | NBAS_HUMAN Isoform 2 of Neuroblastoma-amplified seq |
| SEQ 92 | KEKKR | NBAS_HUMAN Neuroblastoma-amplified sequence |
| SEQ 93 | EKKRR | A2A2M9_HUMAN Synaptonemal complex protein 2 |
| SEQ 94 | EKKRR | A2A340_HUMAN Synaptonemal complex protein 2 |
| SEQ 95 | EKKRR | A2A341_HUMAN Synaptonemal complex protein 2 |
| SEQ 96 | EKKRR | A2A3C1_HUMAN Brain-specific angiogenesis inhibitor |
| SEQ 97 | EKKRR | FI68B_HUMAN Isoform 2 of Myelin-associated neurite |
| SEQ 98 | EKKRR | FI68B_HUMAN Myelin-associated neurite-outgrowth |
| SEQ 99 | RRGAD | A6NDV3_HUMAN Neuroblastoma breakpoint family member |
| SEQ 100 | GADTS | A2A3C2_HUMAN Brain-specific angiogenesis inhibitor |
| SEQ 101 | GADTS | A2A3C3_HUMAN Brain-specific angiogenesis inhibitor |
| SEQ 102 | GADTS | A2A3C4_HUMAN Brain-specific angiogenesis inhibitor |
| SEQ 103 | GADTS | A2A3C6_HUMAN Brain-specific angiogenesis inhibitor |
| SEQ 104 | ADTSV | ESYT2_HUMAN Extended synaptotagmin-2 |
| SEQ 105 | ADTSV | ESYT2_HUMAN Isoform 2 of Extended synaptotagmin-2 |

TABLE 7-continued

| Capsid protein-pentamer BEPI motifs in Zika capsids unique to Zika vs other flaviviruses. |
|---|
| SEQ 106 KKEAM A3KFI2_HUMAN Neuroblastoma suppressor of tumorigen |
| SEQ 107 KKEAM A3KFI3_HUMAN Neuroblastoma suppressor of tumorigen |

TABLE 8

| PrM membrane protein - Pentamer BEPI motifs unique to Zika from other Flaviviruses tested which have neural matches |
|---|
| SEQ 108 ARRSR H0YGA6_HUMAN Neuralized-like protein 2 (Fragment) |
| SEQ 109 ARRSR NEUL2_HUMAN Neuralized-like protein 2 OS = *Homo* sapi |
| SEQ 110 KLQTR SYT6_HUMAN Synaptotagmin-6 OS = *Homo sapiens* GN = SYT6 |
| SEQ 111 KLQTR SYT6_HUMAN Synaptotagmin-6 OS = *Homo sapiens* GN = SYT6 |
| SEQ 112 REYTK H0Y465_HUMAN Neurofibromin truncated (Fragment) OS |
| SEQ 113 REYTK NF1_HUMAN Isoform 1 of Neurofibromin OS = *Homo* sapie |
| SEQ 114 REYTK NF1_HUMAN Neurofibromin OS = *Homo sapiens* GN = NF1 PE= |
| SEQ 115 REYTK H0Y465_HUMAN Neurofibromin truncated (Fragment) OS |
| SEQ 116 REYTK NF1_HUMAN Isoform 1 of Neurofibromin OS = *Homo* sapie |
| SEQ 117 REYTK NF1_HUMAN Neurofibromin OS = *Homo sapiens* GN = NF1 PE= |
| SEQ 118 RKLQT LRRT2_HUMAN Leucine-rich repeat transmembrane neur |
| SEQ 119 RKLQT LRRT2_HUMAN Leucine-rich repeat transmembrane neur |
| SEQ 121 SHSTR F5GZS7_HUMAN Neuregulin-2 OS = *Homo sapiens* GN = NRG2 |
| SEQ 122 SHSTR F5H0N2_HUMAN Neuregulin-2 OS = *Homo sapiens* GN = NRG2 |
| SEQ 123 SHSTR NRG2_HUMAN Isoform 2 of Pro-neuregulin-2 |
| SEQ 124 SHSTR NRG2_HUMAN Isoform 3 of Pro-neuregulin-2 |
| SEQ 125 SHSTR NRG2_HUMAN Isoform 4 of Pro-neuregulin-2 |
| SEQ 126 SHSTR NRG2_HUMAN Isoform DON-1B of Pro-neuregulin-2 |
| SEQ 127 SHSTR NRG2_HUMAN Isoform DON-1R of Pro-neuregulin-2 |
| SEQ 128 SHSTR NRG2_HUMAN Pro-neuregulin-2 |
| SEQ 129 SHSTR F5GZS7_HUMAN Neuregulin-2 OS = *Homo sapiens* GN = NRG2 |
| SEQ 130 SHSTR F5H0N2_HUMAN Neuregulin-2 OS = *Homo sapiens* GN = NRG2 |
| SEQ 131 SHSTR NRG2_HUMAN Isoform 2 of Pro-neuregulin-2 |
| SEQ 132 SHSTR NRG2_HUMAN Isoform 3 of Pro-neuregulin-2 |
| SEQ 133 SHSTR NRG2_HUMAN Isoform 4 of Pro-neuregulin-2 |
| SEQ 134 SHSTR NRG2_HUMAN Isoform DON-1B of Pro-neuregulin-2 |
| SEQ 135 SHSTR NRG2_HUMAN Isoform DON-1R of Pro-neuregulin-2 |
| SEQ 136 SHSTR NRG2_HUMAN Pro-neuregulin-2 |
| SEQ 137 TLPSH NYAP2_HUMAN Neuronal tyrosine-phosphorylated phosp |
| SEQ 138 TLPSH NYAP2_HUMAN Neuronal tyrosine-phosphorylated phosp |
| SEQ 139 ARRSR H0YGA6_HUMAN Neuralized-like protein 2 (Fragment) |
| SEQ 140 ARRSR NEUL2_HUMAN Neuralized-like protein 2 OS = *Homo* sapi |

Example 3. Design and Expression of Synthetic Immunogens Comprising ZIKV Polypeptides ZIKV polypeptides of interest were identified in each domain of the envelope protein, based on the criteria that each polypeptide comprises one or more B cell epitopes and has associated predicted MEW I and MEW II binding peptides. In addition, consideration was given to the mimics identifies as described above. Vector constructs were prepared to incorporate polypeptides of Domain I, Domain II, and Domain III of the envelope protein (SEQS 141-164). Additional polypeptides were selected to exclude the mimic peptides identified (SEQ 165-168). In particular, a construct was prepared to mutate the ESTEN (SEQ ID NO.: 580) motif (SEQS 169-170). The vector constructs were designed to permit the expression of standalone synthetic polypeptides for each domain and additional constructs provided for the expression as a fusion protein with immunoglobulins. While the constructs shown herewith provide for fusion of immunoglobulins to the C terminal of Zika polypeptides, constructs enabling N terminal fusion were also prepared but are not shown. Constructs enabling expression of with either murine or human immunoglobulins were prepared as shown.

A further vector construct was prepared to generate expression of the 34-mer B cell epitope region sequence, GRLITANPVITESTENSKMMLELDPPFGDSYIGE, which encompasses ESTEN (SEQ ID NO.: 171-172). As previously described (U.S. Pat. Nos. 8,703,134; 8,394,379; 7,566,447; and 20130230516; each of which is incorporated herein by reference in its entirety) these constructs are incorporated into retroviral vectors and transfected into CHO cells to create stable expressing protein production cell lines.

A series of constructs were prepared to mutate out a mimic motif which is in Zika envelope Domain 1 and which reacts with Neural navigator proteins 2 (NAV2). The motif which forms a mimic is encoded by the pentamer KGRLS (SEQ ID NO.: 7). Therefore various forms of envelope domain 1 are designed which include mutants of KGRLS (SEQ ID NO.: 7) and which were found not to have other kinds of mimic matches in the proteome. In addition a "triple scramble" version of the soluble portion of the whole envelope protein was prepared which mutates the KGRLS (SEQ ID NO.: 7), the ESTEN (SEQ ID NO.: 580) motif and which in addition mutates out the peptide in Domain II thought to be associates with antibody dependent enhancement in other flavi viruses. This is at position 102 and comprises the motif DRGWGN (SEQ ID NO.: 1259). The sequences which embody these mutants are shown as SEQS 245-254. Many other options exist in configuring mutations or removing mimics by amino acid deletion, thus these SEQs are provided as examples and shall not be considered limiting. Throughout the application, the annotated sequences, peptides, polypeptides, nucleic acids etc., may be identified as SEQ.XXX which corresponds to SEQ ID NO:XXX in the accompanying Sequence ID Listing. For example, Seq.245 is SEQ ID NO:245 in the Sequence ID Listing.

Seq.245. His-EKL-D1-LRKGS, Nucleotide Sequence, ID:501095n
1-69 Signal peptide
70-87 6× Histag
88-111 Enterokinase linker
112-567 Domain 1 extended mutant Seq.246. His-EKL-D1-LRKGS, Amino Acid Sequence, ID:501095p
1-23 Signal peptide
24-29 6× Histag
30-37 Enterokinase linker
38-189 Domain 1 extended mutant Seq.247. His-EKL-D1-RKGLS, Nucleotide Sequence
1-69 Signal peptide
70-87 6× Histag
88-111 Enterokinase linker
112-567 Domain 1 extended mutant Seq.248. His-EKL-D1-RKGLS, Amino Acid Sequence
1-23 Signal peptide
24-29 6× Histag
30-37 Enterokinase linker
38-189 Domain 1 extended mutant Seq.249. His-EKL-D1-KGRIT, Nucleotide Sequence
1-69 Signal peptide
70-87 6× Histag
88-111 Enterokinase linker
112-567 Domain 1 extended mutant Seq.250. His-EKL-D1-KGRIT, Amino Acid Sequence
1-23 Signal peptide
24-29 6× Histag
30-37 Enterokinase linker
38-189 Domain 1 extended mutant Seq.251. His-EKL-D1-GLSKR, Nucleotide Sequence
1-69 Signal peptide
70-87 6× Histag
88-111 Enterokinase linker
112-567 Domain 1 extended mutant Seq.252. His-EKL-D1-GLSKR, Amino Acid Sequence
1-23 Signal peptide
24-29 6× Histag
30-37 Enterokinase linker
38-189 Domain 1 extended mutant Seq.253. His-EKL-Soluble-3Mods, Nucleotide Sequence, ID:501089n
1-69 Signal peptide
70-87 6× Histag
88-111 Enterokinase linker
112-1332 Soluble peptide mutant Seq.254. His-EKL-Soluble-3Mods, Amino Acid Sequence, ID:501089p
1-23 Signal peptide
24-29 6× Histag
30-37 Enterokinase linker
38-444 Soluble peptide mutant Seq.141. His-EKL-Soluble, Nucleotide Sequence, ID:501066n
1-63 Signal peptide
70-87 6× His Tag
88-111 Enterokinase linker
112-1332 soluble peptide Seq.142. His-EKL-Soluble, Amino Acid Sequence, ID:501066p
1-21 Signal peptide
24-29 6× His Tag
30-37 Enterokinase linker
38-444 soluble peptide Seq.143. His-EKL-Domain3, Nucleotide Sequence, ID:501067n
1-63 Signal peptide
70-87 6× His Tag
88-111 Enterokinase linker
112-429 domain3 peptide Seq.144. His-EKL-Domain3, Amino Acid Sequence, ID:501067p 1-21 Signal peptide
24-29 6× His Tag
30-37 Enterokinase linker
38-143 domain3 peptide Seq.145. His-EKL-Domain2, Nucleotide Sequence, ID:501068n 1-63 Signal peptide
70-87 6× His Tag
88-111 Enterokinase linker
112-375 domain2 peptide Seq.146. His-EKL-Domain2, Amino Acid Sequence, ID:501068p 1-21 Signal peptide
24-29 6× His Tag
30-37 Enterokinase linker
38-125 domain2 peptide Seq.147. His-EKL-Domain1, Nucleotide Sequence, ID:501069n 1-63 Signal peptide
70-87 6× His Tag
88-111 Enterokinase linker
112-339 domain1 peptide Seq.148. His-EKL-Domain1, Amino Acid Sequence, ID:501069p 1-21 Signal peptide
24-29 6× His Tag
30-37 Enterokinase linker
38-113 domain1 peptide Seq.149. Soluble-EKL-hG1(CH2-CH3), Nucleotide Sequence, ID:501070n 1-63 Signal peptide
70-1287 soluble peptide
1288-1311 Enterokinase linker
1318-2016 hG1(CH2-CH3) constant region Seq.150. Soluble-EKL-hG1(CH2-CH3), Amino Acid Sequence, ID:501070p 1-21 Signal peptide
24-429 soluble peptide
430-437 Enterokinase linker
440-672 hG1(CH2-CH3) constant region Seq.151. Domain3-EKL-hG1(CH2-CH3), Nucleotide Sequence, ID:501071n 1-63 Signal peptide
70-384 domain3 peptide
385-408 Enterokinase linker
415-1113 hG1(CH2-CH3) constant region Seq.152. Domain3-EKL-hG1(CH2-CH3), Amino Acid Sequence, ID:501071p 1-21 Signal peptide
24-128 domain3 peptide
129-136 Enterokinase linker
139-371 hG1(CH2-CH3) constant region Seq.153. Domain2-EKL-hG1(CH2-CH3), Nucleotide Sequence, ID:501072n 1-63 Signal peptide
70-330 domain2 peptide
331-354 Enterokinase linker
361-1059 hG1(CH2-CH3) constant region Seq.154. Domain2-EKL-hG1(CH2-CH3), Amino Acid Sequence, ID:501072p 1-21 Signal peptide
24-110 domain2 peptide
111-118 Enterokinase linker
121-353 hG1(CH2-CH3) constant region Seq.155. Domain1-EKL-hG1(CH2-CH3), Nucleotide Sequence, ID:501073n 1-63 Signal peptide
70-294 domain1 peptide
295-318 Enterokinase linker
325-1023 hG1(CH2-CH3) constant region Seq.156. Domain1-EKL-hG1(CH2-CH3), Amino Acid Sequence, ID:501073p 1-21 Signal peptide
24-98 domain1 peptide
99-106 Enterokinase linker
109-341 hG1(CH2-CH3) constant region Seq.157. His-Soluble-EKL-mG2a(CH2-CH3), Nucleotide Sequence, ID:501074n 1-63 Signal peptide
70-87 6× Histag
88-1305 soluble peptide
1306-1329 Enterokinase linker
1336-2037 mG2a(CH2-CH3) constant region Seq.158. His-Soluble-EKL-mG2a(CH2-CH3), Amino Acid Sequence, ID:501074p 1-21 Signal peptide
24-29 6× Histag
30-435 soluble peptide
436-443 Enterokinase linker
446-679 mG2a(CH2-CH3) constant region Seq.159. His-Domain3-EKL-mG2a(CH2-CH3), Nucleotide Sequence, ID:501075n 1-63 Signal peptide
70-87 6× Histag
88-402 domain3 peptide
403-426 Enterokinase linker
433-1134 mG2a(CH2-CH3) constant region Seq.160. His-Domain3-EKL-mG2a(CH2-CH3), Amino Acid Sequence, ID:501075p 1-21 Signal peptide
24-29 6× Histag
30-134 domain3 peptide
135-142 Enterokinase linker
145-378 mG2a(CH2-CH3) constant region Seq.161. His-Domain2-EKL-mG2a(CH2-CH3), Nucleotide Sequence, ID:501076n 1-63 Signal peptide
70-87 6× Histag
88-348 domain2 peptide
349-372 Enterokinase linker
379-1080 mG2a(CH2-CH3) constant region Seq.162. His-Domain2-EKL-mG2a(CH2-CH3), Amino Acid Sequence, ID:501076p 1-21 Signal peptide
24-29 6× Histag
30-116 domain2 peptide
117-124 Enterokinase linker
127-360 mG2a(CH2-CH3) constant region Seq.163. His-Domain1-EKL-mG2a(CH2-CH3), Nucleotide Sequence, ID:501077n 1-63 Signal peptide
70-87 6× Histag
88-312 domain1 peptide
313-336 Enterokinase linker
343-1044 mG2a(CH2-CH3) constant region Seq.164. His-Domain1-EKL-mG2a(CH2-CH3), Amino Acid Sequence, ID:501077p
1-21 Signal peptide
24-29 6× Histag
30-104 domain1 peptide
105-112 Enterokinase linker
115-348 mG2a(CH2-CH3) constant region
Seq.165. His-EKL-Mutated_Domain3, Nucleotide Sequence, ID:501078n
1-63 Signal peptide
70-87 6× His Tag
88-111 Enterokinase linker
112-429 mutated domain3 peptide
Seq.166. His-EKL-Mutated_Domain3, Amino Acid Sequence, ID:501078p
1-21 Signal peptide
24-29 6× His Tag
30-37 Enterokinase linker
38-143 mutated domain3 peptide
Seq.167. Mutated_Domain3-EKL-hG1(CH2-CH3), Nucleotide Sequence, ID:501079n
1-63 Signal peptide
70-384 mutated domain3 peptide
385-408 Enterokinase linker
415-1113 hG1(CH2-CH3) constant region
Seq.168. Mutated_Domain3-EKL-hG1(CH2-CH3), Amino Acid Sequence, ID:501079p
1-21 Signal peptide
24-128 domain3 peptide
129-136 Enterokinase linker
139-371 hG1(CH2-CH3) constant region
Seq.169. His-Mutated_Domain3-EKL-mG2a(CH2-CH3), Nucleotide Sequence, ID:501080n
1-63 Signal peptide
70-87 6× Histag
88-402 mutated domain3 peptide
403-426 Enterokinase linker
433-1134 mG2a(CH2-CH3) constant region
Seq.170. His-Mutated_Domain3-EKL-mG2a(CH2-CH3), Amino Acid Sequence, ID:501080p
1-21 Signal peptide
24-29 6× Histag
30-134 domain3 peptide
135-142 Enterokinase linker
145-378 mG2a(CH2-CH3) constant region
Seq.171. His-EKL-Loop-Peptide, Nucleotide Sequence, ID:501081n
1-63 Signal peptide
70-87 6× His Tag
88-111 Enterokinase linker
112-216 loop peptide
Seq.172. His-EKL-Loop-Peptide, Amino Acid Sequence, ID:501081p
1-21 Signal peptide
24-29 6× His Tag
30-37 Enterokinase linker
38-72 loop peptide
Seq.173. SPe-His-NPY, nucleotide sequence, ID:501078n
1-84 Signal peptide
85-102 6× Histag
103-312 Neuropeptide Y
Seq.174. SPe-His-NPY, amino acid sequence, ID:501078p
1-28 Signal peptide
29-34 6× Histag
35-104 Neuropeptide Y
Seq.175. SPe-his-NPY(PDAEG), Nucleotide Sequence, ID:501079n
1-84 Signal peptide
85-102 6× Histag
103-312 Neuropeptide Y
Seq.176. SPe-his-NPY(PDAEG), Amino Acid Sequence, ID:501079p
1-28 Signal peptide
29-34 6× Histag
35-104 Neuropeptide Y
Seq.177. SPe-his-NPY(NTSEE), Nucleotide Sequence, ID:501080n
1-84 Signal peptide
85-102 6× Histag
103-312 Neuropeptide Y
Seq.178. SPe-his-NPY(NTSEE), Amino Acid Sequence, ID:501080p
1-28 Signal peptide
29-34 6× Histag
35-104 Neuropeptide Y
Seq.179. SPe-his-NPY(PDAEG_STNDD), Nucleotide Sequence, ID:501081n
1-84 Signal peptide
85-102 6× Histag
103-312 Neuropeptide Y
Seq.180. SPe-his-NPY(PDAEG_STNDD), Amino Acid Sequence, ID:501081p
1-28 Signal peptide
29-34 6× Histag
35-104 Neuropeptide Y
Seq.181. SPe-his-NPY(PDAEG_Tetanus), Nucleotide Sequence, ID:501082n
1-84 Signal peptide
85-102 6× Histag
103-312 Neuropeptide Y
Seq.182. SPe-his-NPY(PDAEG_Tetanus), Amino Acid Sequence, ID:501082p
1-28 Signal peptide
29-34 6× Histag
35-104 Neuropeptide Y
Seq.183. His-EKL-D3(DSTDN), Nucleotide Sequence, ID:501083n
1-63 Signal peptide
64-87 6× Histag
88-111 Enterokinase linker
111-429 Domain 3 mutant
Seq.184. His-EKL-D3(DSTDN), Amino Acid Sequence, ID:501083p
1-21 Signal peptide
22-29 6× Histag
30-37 Enterokinase linker
38-143 Domain 3 mutant
Seq.185. His-EKL-D3(ETSEQ), Nucleotide Sequence, ID:501084n
1-63 Signal peptide
64-87 6× Histag
88-111 Enterokinase linker
111-429 Domain 3 mutant
Seq.186. His-EKL-D3(ETSEQ), Amino Acid Sequence, ID:501084p
1-21 Signal peptide
22-29 6× Histag
30-37 Enterokinase linker
38-143 Domain 3 mutant Seq.187. His-EKL-D3(KSTEN), Nucleotide Sequence, ID:501085n
1-63 Signal peptide
64-87 6× Histag
88-111 Enterokinase linker
111-429 Domain 3 mutant
Seq.188. His-EKL-D3(KSTEN), Amino Acid Sequence, ID:501085p
1-21 Signal peptide
22-29 6× Histag
30-37 Enterokinase linker
38-143 Domain 3 mutant
Seq.189. His-EKL-D3(NSTEE), Nucleotide Sequence, ID:501086n
1-63 Signal peptide
64-87 6× Histag
88-111 Enterokinase linker
111-429 Domain 3 mutant
Seq.190. His-EKL-D3(NSTEE), Amino Acid Sequence, ID:501086p
1-21 Signal peptide
22-29 6× Histag
30-37 Enterokinase linker
38-143 Domain 3 mutant
Seq.191. His-EKL-D3(DSTEN), Nucleotide Sequence
1-63 Signal peptide
64-87 6× Histag
88-111 Enterokinase linker
111-429 Domain 3 mutant
Seq.192. His-EKL-D3(DSTEN), Amino Acid Sequence
1-21 Signal peptide
22-29 6× Histag
30-37 Enterokinase linker
38-143 Domain 3 mutant
Seq.193. His-EKL-D3(ESTEQ), Nucleotide Sequence
1-63 Signal peptide
64-87 6× Histag
88-111 Enterokinase linker
111-429 Domain 3 mutant
Seq.194. His-EKL-D3(ESTEQ), Amino Acid Sequence
1-21 Signal peptide
22-29 6× Histag
30-37 Enterokinase linker
38-143 Domain 3 mutant
Seq.195. His-EKL-D3(ETSEN), Nucleotide Sequence
1-63 Signal peptide
64-87 6× Histag
88-111 Enterokinase linker
111-429 Domain 3 mutant
Seq.196. His-EKL-D3(ETSEN), Amino Acid Sequence
1-21 Signal peptide
22-29 6× Histag
30-37 Enterokinase linker
38-143 Domain 3 mutant
Seq.197. His-EKL-D3(RSTEN), Nucleotide Sequence
1-63 Signal peptide
64-87 6× Histag
88-111 Enterokinase linker
111-429 Domain 3 mutant
Seq.198. His-EKL-D3(RSTEN), Amino Acid Sequence
1-21 Signal peptide
22-29 6× Histag
30-37 Enterokinase linker
38-143 Domain 3 mutant
Seq.199. D3(DSTDN)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.200. D3(DSTDN)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.201. D3(DSTEN)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.202. D3(DSTEN)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.203. D3(ESTEQ)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.204. D3(ESTEQ)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.205. D3(ETSEN)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.206. D3(ETSEN)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.207. D3(ETSEQ)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.208. D3(ETSEQ)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.209. D3(KSTEN)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.210. D3(KSTEN)-EKL-hG1(CH2-CH3), Amino Acid Sequence
1-21 Signal peptide
22-128 Domain 3 mutant 129-136 Enterokinase linker
137-371 hG1(CH2-CH3) constant region
Seq.211. D3(NSTEE)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.212. D3(NSTEE)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.213. D3(RSTEN)-EKL-hG1(CH2-CH3), Nucleotide Sequence
1-63 Signal peptide
70-384 Domain 3 mutant
385-408 Enterokinase linker
409-1113 hG1(CH2-CH3) constant region
Seq.214. D3(RSTEN)-EKL-hG1(CH2-CH3), Amino Acid Sequence
1-21 Signal peptide
22-128 Domain 3 mutant
129-136 Enterokinase linker
137-371 hG1(CH2-CH3) constant region
Seq.215. His-D3(DSTDN)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.216. His-D3(DSTDN)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.217. His-D3(DSTEN)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.218. His-D3(DSTEN)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.219. His-D3(ESTEQ)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.220. His-D3(ESTEQ)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.221. His-D3(ETSEN)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.222. His-D3(ETSEN)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.223. His-D3(ETSEQ)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.224. His-D3(ETSEQ)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.225. His-D3(KSTEN)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.226. His-D3(KSTEN)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.227. His-D3(NSTEE)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region
Seq.228. His-D3(NSTEE)-EKL-mG2a(CH2-CH3), Amino Acid Sequence
1-21 Signal peptide
22-29 6× Histag
30-134 Domain 3 mutant
135-142 Enterokinase linker
143-378 mG2a(CH2-CH3) constant region
Seq.229. His-D3(RSTEN)-EKL-mG2a(CH2-CH3), Nucleotide Sequence
1-63 Signal peptide
70-87 6× Histag
88-402 Domain 3 mutant
403-426 Enterokinase linker
427-1134 mG2a(CH2-CH3) constant region Seq.230. His-D3(RSTEN)-EKL-mG2a(CH2-CH3), Amino Acid Sequence 1-21 Signal peptide
22-29 6× Histag
30-134 Domain 3 mutant
135-142 Enterokinase linker
143-378 mG2a(CH2-CH3) constant region In some embodiments control peptides (SEQ ID NOs: 231-234) are included which are derived from lysostaphin, as an unrelated irrelevant protein, and which may be detected by control antisera prepared to lysostaphin.

Seq.231. SPe-his-NPY(PDAEG_GSTGYSTAP), Nucleotide Sequence, ID:501083n 1-84 Signal peptide
85-102 6× Histag
103-324 Neuropeptide Y mutant Seq.232. SPe-his-NPY(PDAEG_GSTGYSTAP), Amino Acid Sequence, ID:501083p 1-28 Signal peptide
29-34 6× Histag
35-108 Neuropeptide Y mutant Seq.233. SPe-his-NPY(PDAEG_VMKQDGHVM), Nucleotide Sequence, ID:501084n 1-84 Signal peptide
85-102 6× Histag
103-324 Neuropeptide Y mutant Seq.234. SPe-his-NPY(PDAEG_VMKQDGHVM), Amino Acid Sequence,
ID:501084p 1-28 Signal peptide
29-34 6× Histag
35-108 Neuropeptide Y mutant

Example 4 Additional Neurologic Proteins Containing Mimics for Zika

Searching of the human proteome database using an automated key word search argument revealed additional peptide motifs which are mimics in Zika (source) shared with neurologic protein (targets). The key word search was configured to identify proteins curated to contain "neur" "glial" and "synapt". This revealed pentamer mimics in isoforms of optineurin and in brain derived neurotrophic factor. In both cases the pentamers are within B cell epitopes in both Zika envelope and B cell epitopes in the neurologic protein. In the source protein B cell epitope is defined as having a predicted binding affinity of <−0.6 standard deviation units relative to the protein as a whole and in the target as either high stringency (having a predicted binding affinity of <−0.6 standard deviation units relative to the protein as a whole) or low stringency (having a predicted binding affinity of <−0.3 standard deviation units relative to the protein as a whole).

TABLE 9

| SEQ | Motif | Target neurologic protein |
|---|---|---|
| SEQ 255 | PRAEA | Optineurin (multiple isoforms) UniProtKB - Q96CV9 (OPTN_HUMAN) |
| SEQ 256 | MSGGT | Brain derived neurotropic factor (multiple isoforms) UniProtKB - P23560 (BDNF_HUMAN); also Cochlin, UniProtKB G3V4C4_HUMAN |

Example 5: Epitope Mimics in Dengue Virus Serotype 1

Analysis of the neurologic proteins in which we found epitope mimics in the Zika envelope identified Zika envelope as having a pentamer B cell binding mimic (KGRLS (SEQ ID NO.: 7)) in many isoforms of neural navigator protein 2 (NAV2). Further analysis of NAV2 and other flaviviruses analyzed simultaneously demonstrated a mimic also occurs and is highly conserved in the Domain III loop of dengue type 1 strains. This mimic was present in all 146 South American dengue type 1 isolates analyzed. There is therefore concern that the double mimic which could occur when both Zika and dengue type 1 are co endemic could be adverse or that one or other of the mimics acting alone could have an adverse effect in producing antibodies reactive with this protein which is critical in neural elongation and in early neural tissue development [20, 21]. Thus the present invention includes vaccine proteins in which this mimic has been mutated.

TABLE 10

| Virus | Virus pentamer motif | Virus Envelope position | BEPI strength in Source virus | MHC II in Source virus | NAV2 position | NAV2 Bepi? |
|---|---|---|---|---|---|---|
| Zika (all isolates) | ~KGRLS~ (SEQ ID NO: 7) | 284, Domain I | Moderate | Moderate all DRB and DP and DQ alleles | Position 1013 BEPI centered at position 1015 | yes |
| Dengue (only DEN3 | ~TDKEK~ (SEQ ID NO: 56) | , Domain III loop5* | Moderate | Moderate, not all MHC alleles | Position 1185, BEPI centered at 1187. | Yes |

*as shown in FIG. 12, 13, 14, 15

In order to test the reactivity of sera from ZIKV exposed and dengue exposed subjects to epitope mimics identifies in neural navigator 2 isoforms (NAV2) a series of recombinant polypeptides are prepared including the wild type motifs in NAV2 and scrambled peptide forms of the mimics shown in Table 10, as well as sequences derived from NAV2 which contain appropriate positive and negative controls based on yellow fever and tetanus. Sequences for these constructs are as follows (SEQ ID NOs: 235-244)

Seq.235. His-NN2-KGRLS-TDKEK, Nucleotide Sequence, ID:501090n 1-63 Signal peptide
70-87 6× Histag
88-810 Neuron Navigator 2

Seq.236. His-NN2-KGRLS-TDKEK, Amino Acid Sequence, ID:501090p
1-21 Signal peptide
23-29 6× Histag
30-270 Neuron Navigator 2
Seq.237. His-NN2-LRKGS-TDKEK, Nucleotide Sequence, ID:501091n
1-63 Signal peptide
70-87 6× Histag
88-810 Neuron Navigator 2 mutant
Seq.238. His-NN2-LRKGS-TDKEK, Amino Acid Sequence, ID:501091p
1-21 Signal peptide
23-29 6× Histag
30-270 Neuron Navigator 2 mutant
Seq.239. His-NN2-KGRLS-DTREK, Nucleotide Sequence, ID:501092n
1-63 Signal peptide
70-87 6× Histag
88-810 Neuron Navigator 2 mutant
Seq.240. His-NN2-KGRLS-DTREK, Amino Acid Sequence, ID:501092p
1-21 Signal peptide
23-29 6× Histag
30-270 Neuron Navigator 2 mutant
Seq.241. His-NN2-STNDD-DTREK, Nucleotide Sequence, ID:501093n
1-63 Signal peptide
70-87 6× Histag
88-810 Neuron Navigator 2 mutant
Seq.242. His-NN2-STNDD-DTREK, Amino Acid Sequence, ID:501093p
1-21 Signal peptide
23-29 6× Histag
30-270 Neuron Navigator 2 mutant
Seq.243. His-NN2-SKDVQLKNITDYMYL-DTREK, nucleotide sequence, ID:501094n
1-63 Signal peptide
70-87 6× Histag
88-840 Neuron Navigator 2 mutant
Seq.244. Light Chain Variable Region, Amino Acid Sequence, ID:501094p
1-21 Signal peptide
23-29 6× Histag
30-280 Neuron Navigator 2 mutant

Example 6 Selection of Peptides for Use in a Differential Diagnostic Kit

Given the need to be able to differentially diagnose exposer the Zika virus and dengue viruses types 1-4 and the likely co-endemnicity of yellow fever plus the use of vaccines to both dengue and yellow fever in Zika endemic regions, we identified peptides for each virus envelope which are also in the top 10% of linear B cell binders. We utilized strains for dengue that have recently circulated in Brazil, but the peptides were also cross checked on reference strains of each dengue. The vaccine strain of Yellow fever 17D was included. These were then compared using a missing data array to select peptides (Table 11). A set of high binding B cell epitope pentamers specific for each virus was then assembled as show in Table 12.

TABLE 11

| BEPIPent | SEQ ID NO: | N Rows | 130529 YEFV 17D | (969945757 Zika virus) | GQ330473_D3_BR_RP_A195_2009_3 | GQ379163_YFcase_#2) |
|---|---|---|---|---|---|---|
| ADTGT | 365 | 1 | | 1 | | |
| ADTQG | 306 | 2 | | | | |
| AEENE | 263 | 2 | 1 | | | 1 |
| AEPPF | 533 | 4 | | | 1 | |
| AGTDG | 32 | 1 | | 1 | | |
| APPSE | 1262 | 1 | | | | |
| APTSE | 946 | 2 | | | | |
| ASTND | 264 | 2 | 1 | | | 1 |
| ASTSQ | 283 | 3 | | | | |
| ATEVD | 349 | 3 | | | | |
| ATTET | 324 | 2 | | | 1 | |
| CPSTG | 265 | 2 | 1 | | | 1 |
| CPTQG | 707 | 9 | | 1 | 1 | |
| DEKGV | 284 | 3 | | | | |
| DGQGK | 325 | 2 | | | 1 | |
| DKCPS | 266 | 2 | 1 | | | 1 |
| DSGDG | 350 | 3 | | | | |
| DSRCP | 1263 | 6 | | 1 | 1 | |

TABLE 11-continued

| | | | | | | |
|---|---|---|---|---|---|---|
| DTGHE | 367 | 1 | | 1 | | |
| DTGHG | 267 | 2 | 1 | | | 1 |
| DTGKH | 307 | 2 | | | | |
| DTGTP | 368 | 1 | | 1 | | |
| DTNDN | 268 | 2 | 1 | | | 1 |
| DTQGS | 308 | 2 | | | | |
| DTSNH | 351 | 3 | | | | |
| EDGQG | 326 | 2 | | | 1 | |
| EENEG | 269 | 2 | 1 | | | 1 |
| EGAGA | 352 | 3 | | | | |
| EGDGS | 309 | 2 | | | | |
| EGDNA | 270 | 2 | 1 | | | 1 |
| EGTDA | 285 | 3 | | | | |
| EIQNS | 327 | 2 | | | 1 | |
| EIQTS | 286 | 3 | | | | |
| EKGVT | 287 | 3 | | | | |
| ENEGD | 271 | 2 | 1 | | | 1 |
| ESTEN | 31 | 1 | | 1 | | |
| ETDEN | 370 | 1 | | 1 | | |
| ETPTW | 328 | 2 | | | 1 | |
| ETTEH | 288 | 3 | | | | |
| EVDSG | 353 | 3 | | | | |
| EVSET | 329 | 2 | | | 1 | |
| GADTG | 720 | 1 | | 1 | | |
| GADTQ | 310 | 2 | | | | |
| CASTS | 289 | 3 | | | | |
| GATTE | 330 | 2 | | | 1 | |
| GDGSP | 311 | 2 | | | | |
| GHETD | 372 | 1 | | 1 | | |
| GKAHN | 331 | 2 | | | 1 | |
| GKHGK | 312 | 2 | | | | |
| GNDTG | 313 | 2 | | | | |
| GNDTS | 354 | 3 | | | | |
| GNETQ | 332 | 2 | | | 1 | |
| GNETT | 39 | 3 | | | | |
| GNQEG | 868 | 2 | 1 | | | 1 |
| GQGKA | 333 | 2 | | | 1 | |
| GTDGP | 777 | 1 | | 1 | | |
| GTPHW | 576 | 1 | | 1 | | |
| GVTQN | 291 | 3 | | | | |

TABLE 11-continued

| | | | | | | |
|---|---|---|---|---|---|---|
| HETDE | 573 | 1 | | 1 | | |
| IASTN | 272 | 2 | 1 | | | 1 |
| IQNSG | 334 | 2 | | | 1 | |
| IQTSG | 292 | 3 | | | | |
| ISNTT | 293 | 3 | | | | |
| ITPNS | 1264 | 1 | | 1 | | |
| ITPQA | 1265 | 5 | | | 1 | |
| ITPQS | 314 | 2 | | | | |
| ITPRS | 355 | 3 | | | | |
| KCPST | 44 | 2 | 1 | | | 1 |
| KDTND | 274 | 2 | 1 | | | 1 |
| KGEDA | 335 | 2 | | | 1 | |
| KGRLS | 7 | 1 | | 1 | | |
| KGVTQ | 294 | 3 | | | | |
| NDTGK | 315 | 2 | | | | |
| NDTSN | 356 | 3 | | | | |
| NEGDN | 275 | 2 | 1 | | | 1 |
| NETQG | 336 | 2 | | | 1 | |
| NETTE | 295 | 3 | | | | |
| NPTDT | 276 | 2 | 1 | | | 1 |
| NQEGS | 277 | 2 | 1 | | | 1 |
| NSGGT | 337 | 2 | | | 1 | |
| NSPRA | 378 | 1 | | 1 | | |
| NSRNT | 850 | 3 | | | | |
| NTTTD | 296 | 3 | | | | |
| PHAKK | 316 | 2 | | | | |
| PNSPR | 379 | 1 | | 1 | | |
| PPSE1 | 1266 | 1 | | | | |
| PQAPP | 1267 | 1 | | | | |
| PQAPT | 520 | 2 | | | | |
| PQAST | 792 | 2 | | | 1 | |
| PQSST | 908 | 2 | | | | |
| PRAEA | 380 | 1 | | 1 | | |
| PRSPS | 836 | 3 | | | | |
| PSTGE | 854 | 2 | 1 | | | 1 |
| PTDTG | 279 | 2 | 1 | | | 1 |
| QAPPS | 1268 | 1 | | | | |
| QAPTS | 1269 | 2 | | | | |
| QASTT | 339 | 2 | | | 1 | |
| QEGSL | 280 | 2 | 1 | | | 1 |

TABLE 11-continued

| | | | | | | |
|---|---|---|---|---|---|---|
| QGKAH | 340 | 2 | | | 1 | |
| QNSGG | 341 | 2 | | | 1 | |
| QSSTT | 318 | 2 | | | | |
| QTSGT | 297 | 3 | | | | |
| QVGNE | 790 | 5 | | | 1 | |
| RCPTQ | 558 | 9 | | 1 | 1 | |
| SETQH | 342 | 2 | | | 1 | |
| SGAST | 298 | 3 | | | | |
| SGATT | 343 | 2 | | | 1 | |
| SNTTT | 299 | 3 | | | | |
| SPRAE | 381 | 1 | | 1 | | |
| SQETW | 300 | 3 | | | | |
| SRCPT | 892 | 6 | | 1 | 1 | |
| SRNTS | 359 | 3 | | | | |
| SSTTE | 910 | 2 | | | | |
| STEDG | 344 | 2 | | | 1 | |
| STSQE | 301 | 3 | | | | |
| TDENR | 715 | 1 | | 1 | | |
| TDTGH | 281 | 2 | 1 | | | 1 |
| TEDGQ | 345 | 2 | | | 1 | |
| TEPPF | 302 | 3 | | | | |
| TESTE | 383 | 1 | | 1 | | |
| TETPT | 346 | 2 | | | 1 | |
| TEVDS | 360 | 3 | | | | |
| TGHET | 384 | 1 | | 1 | | |
| TGKHG | 320 | 2 | | | | |
| TGTPH | 385 | 1 | | 1 | | |
| TKDTN | 282 | 2 | 1 | | | 1 |
| TNDNN | 875 | 2 | 1 | | | 1 |
| TNSRN | 361 | 3 | | | | |
| TPNSP | 386 | 1 | | 1 | | |
| TPQAP | 303 | 3 | | | | |
| TPQAS | 347 | 2 | | | 1 | |
| TPQSS | 907 | 2 | | | | |
| TPRSP | 362 | 3 | | | | |
| TQGSN | 322 | 2 | | | | |
| TSNHG | 363 | 3 | | | | |
| TSQET | 304 | 3 | | | | |
| TTEAE | 323 | 2 | | | | |
| TTEHG | 1270 | 3 | | | | |

TABLE 11-continued

| | | | |
|---|---|---|---|
| TTETP | 536 | 2 | 1 |
| TTTDS | 936 | 3 | |
| VDSGD | 364 | 3 | |
| VGNDT | 1271 | 5 | |
| VGNET | 1272 | 5 | 1 |
| VSETQ | 538 | 2 | 1 |
| YEGDG | 919 | 2 | |
| YEGTD | 955 | 3 | |

| BEPIPent | SEQ ID NO: | HQ184924 _SPH306629_Den2) | JF808120_Den3 BR_AL95_2009) | JN848496_SPH323844_Den4) | JQ513335 H778494_Den4 |
|---|---|---|---|---|---|
| ADTGT | 365 | | | | |
| ADTQG | 306 | 1 | | | |
| AEENE | 263 | | | | |
| AEPPF | 533 | 1 | 1 | | |
| AGTDG | 32 | | | | |
| APPSE | 1262 | | | | |
| APTSE | 946 | | | | |
| ASTND | 264 | | | | |
| ASTSQ | 283 | | | | |
| ATEVD | 349 | | | 1 | 1 |
| ATTET | 324 | | 1 | | |
| CPSTG | 265 | | | | |
| CPTQG | 707 | | 1 | 1 | 1 |
| DEKGV | 284 | | | | |
| DGQGK | 325 | | 1 | | |
| DKCPS | 266 | | | | |
| DSGDG | 350 | | | 1 | 1 |
| DSRCP | 1263 | | 1 | | |
| DTGHE | 367 | | | | |
| DTGHG | 267 | | | | |
| DTGKH | 307 | 1 | | | |
| DTGTP | 368 | | | | |
| DTNDN | 268 | | | | |
| DTQGS | 308 | 1 | | | |
| DTSNH | 351 | | | 1 | 1 |
| EDGQG | 326 | | 1 | | |
| EENEG | 269 | | | | |
| EGAGA | 352 | | | 1 | 1 |
| EGDGS | 309 | 1 | | | |
| EGDNA | 270 | | | | |
| EGTDA | 285 | | | | |

TABLE 11-continued

| | | | | | |
|---|---|---|---|---|---|
| EIQNS | 327 | | 1 | | |
| EIQTS | 286 | | | | |
| EKGVT | 287 | | | | |
| ENEGD | 271 | | | | |
| ESTEN | 31 | | | | |
| ETDEN | 370 | | | | |
| ETPTW | 328 | | 1 | | |
| ETTEH | 288 | | | | |
| EVDSG | 353 | | | 1 | 1 |
| EVSET | 329 | | 1 | | |
| GADTG | 720 | | | | |
| GADTQ | 310 | 1 | | | |
| CASTS | 289 | | | | |
| GATTE | 330 | | 1 | | |
| GDGSP | 311 | 1 | | | |
| GHETD | 372 | | | | |
| GKAHN | 331 | | 1 | | |
| GKHGK | 312 | 1 | | | |
| GNDTG | 313 | 1 | | | |
| GNDTS | 354 | | | 1 | 1 |
| GNETQ | 332 | | 1 | | |
| GNETT | 39 | | | | |
| GNQEG | 868 | | | | |
| GQGKA | 333 | | 1 | | |
| GTDGP | 777 | | | | |
| GTPHW | 576 | | | | |
| GVTQN | 291 | | | | |
| HETDE | 573 | | | | |
| IASTN | 272 | | | | |
| IQNSG | 334 | | 1 | | |
| IQTSG | 292 | | | | |
| ISNTT | 293 | | | | |
| ITPNS | 1264 | | | | |
| ITPQA | 1265 | | 1 | | |
| ITPQS | 314 | 1 | | | |
| ITPRS | 355 | | | 1 | 1 |
| KCPST | 44 | | | | |
| KDTND | 274 | | | | |
| KGEDA | 335 | | 1 | | |
| KGRLS | 7 | | | | |

TABLE 11-continued

| | | | | | |
|---|---|---|---|---|---|
| KGVTQ | 294 | | | | |
| NDTGK | 315 | 1 | | | |
| NDTSN | 356 | | | 1 | 1 |
| NEGDN | 275 | | | | |
| NETQG | 336 | | 1 | | |
| NETTE | 295 | | | | |
| NPTDT | 276 | | | | |
| NQEGS | 277 | | | | |
| NSGGT | 337 | | 1 | | |
| NSPRA | 378 | | | | |
| NSRNT | 850 | | | 1 | 1 |
| NTTTD | 296 | | | | |
| PHAKK | 316 | 1 | | | |
| PNSPR | 379 | | | | |
| PPSE1 | 1266 | | | | |
| PQAPP | 1267 | | | | |
| PQAPT | 520 | | | | |
| PQAST | 792 | | 1 | | |
| PQSST | 908 | 1 | | | |
| PRAEA | 380 | | | | |
| PRSPS | 836 | | | 1 | 1 |
| PSTGE | 854 | | | | |
| PTDTG | 279 | | | | |
| QAPPS | 1268 | | | | |
| QAPTS | 1269 | | | | |
| QASTT | 339 | | 1 | | |
| QEGSL | 280 | | | | |
| QGKAH | 340 | | 1 | | |
| QNSGG | 341 | | 1 | | |
| QSSTT | 318 | 1 | | | |
| QTSGT | 297 | | | | |
| QVGNE | 790 | | 1 | | |
| RCPTQ | 558 | | 1 | 1 | 1 |
| SETQH | 342 | | 1 | | |
| SGAST | 298 | | | | |
| SGATT | 343 | | 1 | | |
| SNTTT | 299 | | | | |
| SPRAE | 381 | | | | |
| SQETW | 300 | | | | |
| SRCPT | 892 | | 1 | | |

TABLE 11-continued

| | | | | | |
|---|---|---|---|---|---|
| SRNTS | 359 | | | 1 | 1 |
| SSTTE | 910 | 1 | | | |
| STEDG | 344 | | 1 | | |
| STSQE | 301 | | | | |
| TDENR | 715 | | | | |
| TDTGH | 281 | | | | |
| TEDGQ | 345 | | 1 | | |
| TEPPF | 302 | | | | |
| TESTE | 383 | | | | |
| TETPT | 346 | | 1 | | |
| TEVDS | 360 | | | 1 | 1 |
| TGHET | 384 | | | | |
| TGKHG | 320 | | | | |
| TGTPH | 385 | | | | |
| TKDTN | 282 | | | | |
| TNDNN | 875 | | | | |
| TNSRN | 361 | | | 1 | 1 |
| TPNSP | 386 | | | | |
| TPQAP | 303 | | | | |
| TPQAS | 347 | | 1 | | |
| TPQSS | 907 | 1 | | | |
| TPRSP | 362 | | | 1 | 1 |
| TQGSN | 322 | 1 | | | |
| TSNHG | 363 | | | 1 | 1 |
| TSQET | 304 | | | | |
| TTEAE | 323 | 1 | | | |
| TTEHG | 1270 | | | | |
| TTETP | 536 | | 1 | | |
| TTTDS | 936 | | | | |
| VDSGD | 364 | | | 1 | 1 |
| VGNDT | 1271 | 1 | | 1 | 1 |
| VGNET | 1272 | | 1 | | |
| VSETQ | 538 | | 1 | | |
| YEGDG | 919 | 1 | | | |
| YEGTD | | | | | |

| BEPIPent | SEQ ID NO: | KP858105_Den1_GO091_ 2013_BR | KP858119_Den1_GO280_ 2013_BR | HQ184925_den2_ SPH306593_2 |
|---|---|---|---|---|
| ADTGT | 365 | | | |
| ADTQG | 306 | | | 1 |
| AEENE | 263 | | | |
| AEPPF | 533 | | | 1 |

TABLE 11-continued

| | | | | |
|---|---|---|---|---|
| AGTDG | 32 | | | |
| APPSE | 1262 | | 1 | |
| APTSE | 946 | 1 | | |
| ASTND | 264 | | | |
| ASTSQ | 283 | 1 | 1 | |
| ATEVD | 349 | | | |
| ATTET | 324 | | | |
| CPSTG | 265 | | | |
| CPTQG | 707 | 1 | 1 | |
| DEKGV | 284 | 1 | 1 | |
| DGQGK | 325 | | | |
| DKCPS | 266 | | | |
| DSGDG | 350 | | | |
| DSRCP | 1263 | 1 | 1 | |
| DTGHE | 367 | | | |
| DTGHG | 267 | | | |
| DTGKH | 307 | | | 1 |
| DTGTP | 368 | | | |
| DTNDN | 268 | | | |
| DTQGS | 308 | | | 1 |
| DTSNH | 351 | | | |
| EDGQG | 326 | | | |
| EENEG | 269 | | | |
| EGAGA | 352 | | | |
| EGDGS | 309 | | | 1 |
| EGDNA | 270 | | | |
| EGTDA | 285 | 1 | 1 | |
| EIQNS | 327 | | | |
| EIQTS | 286 | 1 | 1 | |
| EKGVT | 287 | 1 | 1 | |
| ENEGD | 271 | | | |
| ESTEN | 31 | | | |
| ETDEN | 370 | | | |
| ETPTW | 328 | | | |
| ETTEH | 288 | 1 | 1 | |
| EVDSG | 353 | | | |
| EVSET | 329 | | | |
| GADTG | 720 | | | |
| GADTQ | 310 | | | 1 |
| CASTS | 289 | 1 | 1 | |

TABLE 11-continued

| | | | | |
|---|---|---|---|---|
| GATTE | 330 | | | |
| GDGSP | 311 | | | 1 |
| GHETD | 372 | | | |
| GKAHN | 331 | | | |
| GKHGK | 312 | | | 1 |
| GNDTG | 313 | | | 1 |
| GNDTS | 354 | | | |
| GNETQ | 332 | | | |
| GNETT | 39 | 1 | 1 | |
| GNQEG | 868 | | | |
| GQGKA | 333 | | | |
| GTDGP | 777 | | | |
| GTPHW | 576 | | | |
| GVTQN | 291 | 1 | 1 | |
| HETDE | 573 | | | |
| IASTN | 272 | | | |
| IQNSG | 334 | | | |
| IQTSG | 292 | 1 | 1 | |
| ISNTT | 293 | 1 | 1 | |
| ITPNS | 1264 | | | |
| ITPQA | 1265 | 1 | 1 | |
| ITPQS | 314 | | | 1 |
| ITPRS | 355 | | | |
| KCPST | 44 | | | |
| KDTND | 274 | | | |
| KGEDA | 335 | | | |
| KGRLS | 7 | | | |
| KGVTQ | 294 | 1 | 1 | |
| NDTGK | 315 | | | 1 |
| NDTSN | 356 | | | |
| NEGDN | 275 | | | |
| NETQG | 336 | | | |
| NETTE | 295 | 1 | 1 | |
| NPTDT | 276 | | | |
| NQEGS | 277 | | | |
| NSGGT | 337 | | | |
| NSPRA | 378 | | | |
| NSRNT | 850 | | | |
| NTTTD | 296 | 1 | 1 | |
| PHAKK | 316 | | | 1 |

TABLE 11-continued

| | | | | |
|---|---|---|---|---|
| PNSPR | 379 | | | |
| PPSE1 | 1266 | | 1 | |
| PQAPP | 1267 | | 1 | |
| PQAPT | 520 | 1 | | |
| PQAST | 792 | | | |
| PQSST | 908 | | | 1 |
| PRAEA | 380 | | | |
| PRSPS | 836 | | | |
| PSTGE | 854 | | | |
| PTDTG | 279 | | | |
| QAPPS | 1268 | | 1 | |
| QAPTS | 1269 | 1 | | |
| QASTT | 339 | | | |
| QEGSL | 280 | | | |
| QGKAH | 340 | | | |
| QNSGG | 341 | | | |
| QSSTT | 318 | | | 1 |
| QTSGT | 297 | | 1 | |
| QVGNE | 790 | | 1 | |
| RCPTQ | 558 | 1 | 1 | |
| SETQH | 342 | | | |
| SGAST | 298 | 1 | 1 | |
| SGATT | 343 | | | |
| SNTTT | 299 | 1 | 1 | |
| SPRAE | 381 | | | |
| SQETW | 300 | 1 | 1 | |
| SRCPT | 892 | 1 | 1 | |
| SRNTS | 359 | | | |
| SSTTE | 910 | | | 1 |
| STEDG | 344 | | | |
| STSQE | 301 | 1 | 1 | |
| TDENR | 715 | | | |
| TDTGH | 281 | | | |
| TEDGQ | 345 | | | |
| TEPPF | 302 | 1 | 1 | |
| TESTE | 383 | | | |
| TETPT | 346 | | | |
| TEVDS | 360 | | | |
| TGHET | 384 | | | |
| TGKHG | 320 | | | 1 |

TABLE 11-continued

| | | | | |
|---|---|---|---|---|
| TGTPH | 385 | | | |
| TKDTN | 282 | | | |
| TNDNN | 875 | | | |
| TNSRN | 361 | | | |
| TPNSP | 386 | | | |
| TPQAP | 303 | 1 | 1 | |
| TPQAS | 347 | | | |
| TPQSS | 907 | | | 1 |
| TPRSP | 362 | | | |
| TQGSN | 322 | | | 1 |
| TSNHG | 363 | | | |
| TSQET | 304 | 1 | 1 | |
| TTEAE | 323 | | | 1 |
| TTEHG | 1270 | 1 | 1 | |
| TTETP | 536 | | | |
| TTTDS | 936 | 1 | 1 | |
| VDSGD | 364 | | | |
| VGNDT | 1271 | | | 1 |
| VGNET | 1272 | 1 | 1 | |
| VSETQ | 538 | | | |
| YEGDG | 919 | | | 1 |
| YEGTD | 955 | 1 | 1 | |

| BEPIPent | SEQ ID NO: | JN848499_Den4_SPH318527_4 | KP858111_Den1_GO166_2013_BR) |
|---|---|---|---|
| ADTGT | 365 | | |
| ADTQG | 306 | | |
| AEENE | 263 | | |
| AEPPF | 533 | | |
| AGTDG | 32 | | |
| APPSE | 1262 | | |
| APTSE | 946 | | 1 |
| ASTND | 264 | | |
| ASTSQ | 283 | | 1 |
| ATEVD | 349 | 1 | |
| ATTET | 324 | | |
| CPSTG | 265 | | |
| CPTQG | 707 | 1 | 1 |
| DEKGV | 284 | | 1 |
| DGQGK | 325 | | |
| DKCPS | 266 | | |

TABLE 11-continued

| | | | |
|---|---|---|---|
| DSGDG | 350 | 1 | |
| DSRCP | 1263 | | 1 |
| DTGHE | 367 | | |
| DTGHG | 267 | | |
| DTGKH | 307 | | |
| DTGTP | 368 | | |
| DTNDN | 268 | | |
| DTQGS | 308 | | |
| DTSNH | 351 | 1 | |
| EDGQG | 326 | | |
| EENEG | 269 | | |
| EGAGA | 352 | 1 | |
| EGDGS | 309 | | |
| EGDNA | 270 | | |
| EGTDA | 285 | | 1 |
| EIQNS | 327 | | |
| EIQTS | 286 | | 1 |
| EKGVT | 287 | | 1 |
| ENEGD | 271 | | |
| ESTEN | 31 | | |
| ETDEN | 370 | | |
| ETPTW | 328 | | |
| ETTEH | 288 | | 1 |
| EVDSG | 353 | 1 | |
| EVSET | 329 | | |
| GADTG | 720 | | |
| GADTQ | 310 | | |
| CASTS | 289 | | 1 |
| GATTE | 330 | | |
| GDGSP | 311 | | |
| GHETD | 372 | | |
| GKAHN | 331 | | |
| GKHGK | 312 | | |
| GNDTG | 313 | | |
| GNDTS | 354 | 1 | |
| GNETQ | 332 | | |
| GNETT | 39 | | 1 |
| GNQEG | 868 | | |
| GQGKA | 333 | | |
| GTDGP | 777 | | |

TABLE 11-continued

| | | | |
|---|---|---|---|
| GTPHW | 576 | | |
| GVTQN | 291 | | 1 |
| HETDE | 573 | | |
| IASTN | 272 | | |
| IQNSG | 334 | | |
| IQTSG | 292 | | 1 |
| ISNTT | 293 | | 1 |
| ITPNS | 1264 | | |
| ITPQA | 1265 | | 1 |
| ITPQS | 314 | | |
| ITPRS | 355 | 1 | |
| KCPST | 44 | | |
| KDTND | 274 | | |
| KGEDA | 335 | | |
| KGRLS | 7 | | |
| KGVTQ | 294 | | 1 |
| NDTGK | 315 | | |
| NDTSN | 356 | 1 | |
| NEGDN | 275 | | |
| NETQG | 336 | | |
| NETTE | 295 | | 1 |
| NPTDT | 276 | | |
| NQEGS | 277 | | |
| NSGGT | 337 | | |
| NSPRA | 378 | | |
| NSRNT | 850 | 1 | |
| NTTTD | 296 | | 1 |
| PHAKK | 316 | | |
| PNSPR | 379 | | |
| PPSE1 | 1266 | | |
| PQAPP | 1267 | | |
| PQAPT | 520 | | 1 |
| PQAST | 792 | | |
| PQSST | 908 | | |
| PRAEA | 380 | | |
| PRSPS | 836 | 1 | |
| PSTGE | 854 | | |
| PTDTG | 279 | | |
| QAPPS | 1268 | | |
| QAPTS | 1269 | | 1 |

TABLE 11-continued

| | | | |
|---|---|---|---|
| QASTT | 339 | | |
| QEGSL | 280 | | |
| QGKAH | 340 | | |
| QNSGG | 341 | | |
| QSSTT | 318 | | |
| QTSGT | 297 | | 1 |
| QVGNE | 790 | | 1 |
| RCPTQ | 558 | 1 | 1 |
| SETQH | 342 | | |
| SGAST | 298 | | 1 |
| SGATT | 343 | | |
| SNTTT | 299 | | 1 |
| SPRAE | 381 | | |
| SQETW | 300 | | 1 |
| SRCPT | 892 | | 1 |
| SRNTS | 359 | 1 | |
| SSTTE | 910 | | |
| STEDG | 344 | | |
| STSQE | 301 | | 1 |
| TDENR | 715 | | |
| TDTGH | 281 | | |
| TEDGQ | 345 | | |
| TEPPF | 302 | | 1 |
| TESTE | 383 | | |
| TETPT | 346 | | |
| TEVDS | 360 | 1 | |
| TGHET | 384 | | |
| TGKHG | 320 | | |
| TGTPH | 385 | | |
| TKDTN | 282 | | |
| TNDNN | 875 | | |
| TNSRN | 361 | 1 | |
| TPNSP | 386 | | |
| TPQAP | 303 | | 1 |
| TPQAS | 347 | | |
| TPQSS | 907 | | |
| TPRSP | 362 | 1 | |
| TQGSN | 322 | | |
| TSNHG | 363 | 1 | |
| TSQET | 304 | | 1 |

TABLE 11-continued

| | | | |
|---|---|---|---|
| TTEAE | 323 | | |
| TTEHG | 1270 | | 1 |
| TTETP | 536 | | |
| TTTDS | 936 | | 1 |
| VDSGD | 364 | 1 | |
| VGNDT | 1271 | 1 | |
| VGNET | 1272 | | 1 |
| VSETQ | 538 | | |
| YEGDG | 919 | | |
| YEGTD | 955 | | 1 |

TABLE 12

| Yellow fever | SEQ ID NO | Den1 | SEQ ID NO | Den2 | SEQ ID NO | Den3 | SEQ ID NO | Den4 | SEQ ID NO | Zika | SEQ ID NO | Cross reactive DEN1-4 | SEQ ID NO | Not Zika | SEQ ID NO |
|---|---|---|---|---|---|---|---|---|---|---|---|---|---|---|---|
| AEENE | SEQ 263 | ASTSQ | SEQ 283 | ADTQG | SEQ 306 | ATTET | SEQ 324 | ATEVD | SEQ 349 | ADTGT | SEQ 365 | EPPFG | SEQ 387 | GSSIG | SEQ 391 |
| ASTND | SEQ 264 | DEKGV | SEQ 284 | DTGKH | SEQ 307 | DGQGK | SEQ 325 | DSGDG | SEQ 350 | AGTDG | SEQ 366 | ETQHG | SEQ 388 | | |
| CPSTG | SEQ 265 | EGTDA | SEQ 285 | DTQGS | SEQ 308 | EDGQG | SEQ 326 | DTSNH | SEQ 351 | DTGHE | SEQ 367 | KGSSI | SEQ 389 | | |
| DKCPS | SEQ 266 | EIQTS | SEQ 286 | EGDGS | SEQ 309 | EIQNS | SEQ 327 | EGAGA | SEQ 352 | DTGTP | SEQ 368 | QEGAM | SEQ 390 | | |
| DTGHG | SEQ 267 | EKGVT | SEQ 287 | GADTQ | SEQ 310 | ETPTW | SEQ 328 | EVDSG | SEQ 353 | ESTEN | SEQ 369 | | | | |
| DTNDN | SEQ 268 | ETTEH | SEQ 288 | GDGSP | SEQ 311 | EVSET | SEQ 329 | GNDTS | SEQ 354 | ETDEN | SEQ 370 | | | | |
| EENEG | SEQ 269 | GASTS | SEQ 289 | GKHGK | SEQ 312 | GATTE | SEQ 330 | ITPRS | SEQ 355 | GADTG | SEQ 371 | | | | |
| EGDNA | SEQ 270 | GNETT | SEQ 290 | GNDTG | SEQ 313 | GKAHN | SEQ 331 | NDTSN | SEQ 356 | GHETD | SEQ 372 | | | | |
| ENEGD | SEQ 271 | GVTQN | SEQ 291 | ITPQS | SEQ 314 | GNETQ | SEQ 332 | NSRNT | SEQ 357 | GTDGP | SEQ 373 | | | | |
| IASTN | SEQ 272 | IQTSG | SEQ 292 | NDTGK | SEQ 315 | GQGKA | SEQ 333 | PRSPS | SEQ 358 | GTPHW | SEQ 374 | | | | |
| KCPST | SEQ 273 | ISNTT | SEQ 293 | PHAKK | SEQ 316 | IQNSG | SEQ 334 | SRNTS | SEQ 359 | HETDE | SEQ 375 | | | | |
| KDTND | SEQ 274 | KGVTQ | SEQ 294 | PQSST | SEQ 317 | KGEDA | SEQ 335 | TEVDS | SEQ 360 | ITPNS | SEQ 376 | | | | |
| NEGDN | SEQ 275 | NETTE | SEQ 295 | QSSTT | SEQ 318 | NETQG | SEQ 336 | TNSRN | SEQ 361 | KGRLS | SEQ 377 | | | | |
| NPTDT | SEQ 276 | NTTTD | SEQ 296 | SSTTE | SEQ 319 | NSGGT | SEQ 337 | TPRSP | SEQ 362 | NSPRA | SEQ 378 | | | | |
| NQEGS | SEQ 277 | QTSGT | SEQ 297 | TGKHG | SEQ 320 | PQAST | SEQ 338 | TSNHG | SEQ 363 | PNSPR | SEQ 379 | | | | |
| PSTGE | SEQ 278 | SGAST | SEQ 298 | TPQSS | SEQ 321 | QASTT | SEQ 339 | VDSGD | SEQ 364 | PRAEA | SEQ 380 | | | | |
| PTDTG | SEQ 279 | SNTTT | SEQ 299 | TQGSN | SEQ 322 | QGKAH | SEQ 340 | | | SPRAE | SEQ 381 | | | | |

TABLE 12-continued

| Yellow fever | SEQ ID NO | Den1 | SEQ ID NO | Den2 | SEQ ID NO | Den3 | SEQ ID NO | Den4 | SEQ ID NO | Zika | SEQ ID NO | Cross reactive DEN1-4 | SEQ ID NO | Not Zika | SEQ ID NO |
|---|---|---|---|---|---|---|---|---|---|---|---|---|---|---|---|
| QEGSL | SEQ 280 | SQETW | SEQ 300 | TTEAE | SEQ 323 | QNSGG | SEQ 341 | | | TDENR | SEQ 382 | | | | |
| TDTGH | SEQ 281 | STSQE | SEQ 301 | | | SETQH | SEQ 342 | | | TESTE | SEQ 383 | | | | |
| TKDTN | SEQ 282 | TEPPF | SEQ 302 | | | SGATT | SEQ 343 | | | TGHET | SEQ 384 | | | | |
| | | TPQAP | SEQ 303 | | | STEDG | SEQ 344 | | | TGTPH | SEQ 385 | | | | |
| | | TSQET | SEQ 304 | | | TEDGQ | SEQ 345 | | | TPNSP | SEQ 386 | | | | |
| | | TTDS | SEQ 305 | | | TETPT | SEQ 346 | | | | | | | | |
| | | | | | | TPQAS | SEQ 347 | | | | | | | | |
| | | | | | | YKGED | SEQ 348 | | | | | | | | |

These peptides can be synthesized chemically with or without the contextual flanking regions of up to five amino acids each side and with or without histags or FLAG tags. As reagents they are used attached to a solid (paper or plastic, among other possibilities know to those skilled in the art) or semisolid (for example, but not limited to, agarose, nitrocellulose) medium or utilized in suspension in a capture mode. In addition, a secondary immunoglobulin binding colorimetric secondary antibody can facilitate test readout. By recording the pattern of binding to an array of peptides it is possible to differentiate between prior exposure of a subject to each or multiple of the viruses. An array may be very simple with only 1-5 of the peptides shown for each virus, or a subset thereof, or may incorporate up to all of the peptides in Table 12. The peptides may be used for simple clinical differential diagnosis. They may also be utilized to determine the duration of antibody titers to each peptide, in which case many or all of the peptides will be employed. For instance, the duration of antibody titers to mimics such as the pentamer ESTEN (SEQ ID NO.: 31) in Zika (or others described herein, so this example is not considered limiting) are important in determining when a pregnancy may be safe without risking transplacental antibody transfer adverse to fetal development. Similarly, the test kit may be used to assess vaccine efficacy in raising appropriate protective antibodies rather than those targeting mimics.

Example 7: An Engineered Zika Vaccine Component with Multiple Mutations

In order to generate a vaccine candidate envelope protein in which antibody mediated mimicry is mitigated, we generated an envelope protein amino acid sequence in which the pentamer mimic motifs ESTEN (SEQ ID NO.: 31), LGRLS (SEQ ID NO.: 1273), PRAEA (SEQ ID NO.: 380), and GADTG (SEQ ID NO.: 720) were each replaced with a pentamer of different amino acids. In addition, the pentamer DRGWG (SEQ ID NO.: 554) was replaced as this motif is associated with potential cross reactivity with other flaviviruses leading to antibody dependent enhancement. As a result of introduction of new pentamer motifs the new sequence was reexamined to determine that the location of B and T cell motifs has not been disrupted and that the new pentamers, and those arising in the flanks of each new pentamer did not give rise to new problematic mimics. Hence for each pentamer replaced a minimum of 9 new pentamers were evaluated for new mimics. Therefore, the analysis of B cell epitope mimics was repeated with the novel sequences. Sequences 392 to 397 provide the sequences for a preferred envelope protein with the mimics replaced. It will be evident to those skilled in the art that other replacement pentamers may be equally suitable and thus these sequences provide examples which are not considered limiting. The envelope proteins comprising the mimics may be incorporated into vaccines using one of many delivery vehicles known to the art as previously discussed, including but not limited to Fc fusions, virus like particles, vectored via adeno or poxviruses, chimeras, or as DNA. Thus the inclusion of Fc fusion examples in the sequences shown is not considered limiting.

Seq.392. His-EKL-Soluble-Nucleotide Sequence
1-63 Signal peptide
70-87 6× His Tag
88-111 Enterokinase linker
112-1332 Soluble envelope with 5 mutations Seq.393. His-EKL-Soluble-Amino Acid Sequence
1-21 Signal peptide
22-29 6× His Tag
30-37 Enterokinase linker
38-444 Soluble envelope with 5 mutations Seq.394. Soluble Nucleotide Sequence
1-63 Signal peptide
69-1287 Soluble envelope with 5 mutations
1288-1311 Enterokinase linker
1312-2016 hG1(CH2-CH3) constant region Seq.395. Soluble Amino Acid Sequence
1-21 Signal peptide
23-429 Soluble envelope with 5 mutations
430-437 Enterokinase linker
438-672 hG1(CH2-CH3) constant region Seq.396. His-Soluble Nucleotide Sequence
1-63 Signal peptide
72-87 6× His Tag
88-1305 Soluble envelope with 5 mutations 1306-1329 Enterokinase Linker
1336-2037 mG2a(CH2-CH3) constant region
Seq.397. His-Soluble Amino Acid Sequence
1-21 Signal peptide
24-29 6× His Tag
30-435 Soluble envelope with 5 mutations
436-443 Enterokinase Linker
446-679 mG2a(CH2-CH3) constant region In addition to preparing components of the envelope as standalone ZIKV envelope domain sequences and as immunoglobulin fusions, subviral particles were also constructed comprising PrMEnv. This was conducted generally following the methods of Merino-Ramos et al (PLoS ONE 9(9): e108056. doi:10.1371. Sub viral particles were constructed which comprised mutant versions of four of the above referenced mimic peptides (PRAEA (SEQ ID NO.: 575), AGADT (SEQ ID NO.: 719), KGRLS (SEQ ID NO.: 724), ESTEN (SEQ ID NO.: 31)) and also with only the Domain II pan flavi cross reactive motif DRGWG (SEQ ID NO.: 554). In addition, control sequences which contained no motif changes from the wild type were constructed also as subviral particles. These are shown below as SEQS 257-262. The sequences were transfected into Vero and CHO cells and subviral particles expressed for testing of their immunogenicity in mice.

Seq.257. jeSP-prME(NGWGRD), Nucleotide Sequence
1-72 Signal peptide
77-1809 ZikV prME with NGWGRD mutation
Seq.258. jeSP-prME(NGWGRD), Amino Acid Sequence
1-24 Signal peptide
25-603 ZikV prME with NGWGRD mutation
Seq.259. jeSP-prME(PEARA-GEKAP-LRKGS-NTSEE), Nucleotide Sequence
1-72 Signal peptide
77-1809 ZikV prME with PEARA-GEKAP-LRKGS-NTSEE mutations
Seq.260. jeSP-prME(PEARA-GEKAP-LRKGS-NTSEE), Amino Acid Sequence
1-24 Signal peptide
25-603 ZikV prME with PEARA-GEKAP-LRKGS-NTSEE mutations
Seq.261. jeSP-prME, Nucleotide Sequence
1-72 Signal peptide
77-1809 ZikV prME
Seq.262. ZikV prME, Amino Acid Sequence
1-24 Signal peptide
25-603 ZikV prME Example 8: Synthetic and Engineered Neurologic Proteins The human proteins of neurologic function which contain epitope mimics for Zika virus have been identified above. In order to evaluate the role of such mimic epitopes in the pathogenesis of Zika virus and dengue we developed recombinant versions of the neurologic proteins of interest in which the wild type epitope motif is retained and versions in which one or more of the epitope mimics for Zika or dengue is replaced. In addition, control motifs are included for yellow fever and tetanus toxin. Sequences 173-182 provide an example of such sequences for neuropeptide Y. A further set of recombinant proteins was developed which are based on NAV 2 and which include the wild type and replacement pentamers for the predicted mimics, KGRLS (SEQ ID NO.: 577) (Zika) and TDKEK (SEQ ID NO.: 56) (dengue 1). Given the size of NAV2, over 2800 amino acids, we elected in this example to only use the central portion of the protein spanning both Zika and dengue 1 mimics. This is shown in Sequence 235 to 244. A similar approach is taken with other human proteins containing mimic epitopes for Zika or dengue and thus the examples shown for NAV2 and NPY are not limiting.

In a further embodiment the synthetic neurologic proteins are expressed as a fusion with an immunoglobulin Fc region. In yet another embodiment the synthetic polypeptide derived from neuropeptide Y is mutated to prevent the cleavage of mature NPY from the CPON component. These modifications of the proteins are shown in SEQS 398 to 437.

Seq.398. His-NAV2(KGRLS-TDKEK)-EKL-mG2a (CH2-CH3), Nucleotide Sequence
1-63 Signal peptide
70-87 6× His Tag
88-807 Neuron Navigator 2
808-831 Enterokinase Linker
838-1539 mG2a(CH2-CH3) constant region
Seq.399. His-NAV2(KGRLS-TDKEK)-EKL-mG2a (CH2-CH3), Amino Acid Sequence
1-21 Signal peptide
22-29 6× His Tag
30-269 Neuron Navigator 2
270-277 Enterokinase Linker
278-513 mG2a(CH2-CH3) constant region
Seq.400. His-NAV2(LRKGS-TDKEK)-EKL-mG2a (CH2-CH3), Nucleotide Sequence
1-63 Signal peptide
70-87 6× His Tag
88-807 Neuron Navigator 2
808-831 Enterokinase Linker
838-1539 mG2a(CH2-CH3) constant region
Seq.401. His-NAV2(LRKGS-TDKEK)-EKL-mG2a (CH2-CH3), Amino Acid Sequence
1-21 Signal peptide
22-29 6× His Tag
30-269 Neuron Navigator 2
270-277 Enterokinase Linker
278-513 mG2a(CH2-CH3) constant region
Seq.402. His-NAV2(KGRLS-DTREK)-EKL-mG2a (CH2-CH3), Nucleotide Sequence
1-63 Signal peptide
70-87 6× His Tag
88-807 Neuron Navigator 2
808-831 Enterokinase Linker
838-1539 mG2a(CH2-CH3) constant region
Seq.403. His-NAV2(KGRLS-DTREK)-EKL-mG2a (CH2-CH3), Amino Acid Sequence
1-21 Signal peptide
22-29 6× His Tag
30-269 Neuron Navigator 2
270-277 Enterokinase Linker
278-513 mG2a(CH2-CH3) constant region
Seq.404. His-NAV2(STNDD-DTREK)-EKL-mG2a (CH2-CH3), Nucleotide Sequence
1-63 Signal peptide
70-87 6× His Tag
88-807 Neuron Navigator 2
808-831 Enterokinase Linker
838-1539 mG2a(CH2-CH3) constant region
Seq.405. His-NAV2(STNDD-DTREK)-EKL-mG2a (CH2-CH3), Amino Acid Sequence
1-21 Signal peptide
22-29 6× His Tag
30-269 Neuron Navigator 2
270-277 Enterokinase Linker
278-513 mG2a(CH2-CH3) constant region Seq.406. His-NAV2(SL15-DTREK)-EKL-mG2a(CH2-CH3), Nucleotide Sequence
1-63 Signal peptide
70-87 6× His Tag
88-837 Neuron Navigator 2
838-861 Enterokinase Linker
868-1569 mG2a(CH2-CH3) constant region
Seq.407. Heavy Chain Variable Region, Amino Acid Sequence, ID:500p
1-21 Signal peptide
22-29 6× His Tag
30-279 Neuron Navigator 2
280-287 Enterokinase Linker
288-523 mG2a(CH2-CH3) constant region
Seq.408. mG2a(CH2-CH3)-EKL-NAV2(KGRLS-TD-KEK)-his, Nucleotide Sequence
1-63 Signal peptide
70-768 mG2a(CH2-CH3) constant region
778-801 Enterokinase Linker
802-1521 Neuron Navigator 2
1522-1539 6× His Tag
Seq.409. mG2a(CH2-CH3)-EKL-NAV2(KGRLS-TD-KEK)-his, Amino Acid Sequence
1-21 Signal peptide
22-256 mG2a(CH2-CH3) constant region
260-267 Enterokinase Linker
268-507 Neuron Navigator 2
508-513 6× His Tag
Seq.410. mG2a(CH2-CH3)-EKL-NAV2(LRKGS-TD-KEK)-his, Nucleotide Sequence
1-63 Signal peptide
70-768 mG2a(CH2-CH3) constant region
778-801 Enterokinase Linker
802-1521 Neuron Navigator 2
1522-1539 6× His Tag
Seq.411. mG2a(CH2-CH3)-EKL-NAV2(LRKGS-TD-KEK)-his, Amino Acid Sequence
1-21 Signal peptide
22-256 mG2a(CH2-CH3) constant region
260-267 Enterokinase Linker
268-507 Neuron Navigator 2
508-513 6× His Tag
Seq.412. mG2a(CH2-CH3)-EKL-NAV2(KGRLS-DTREK)-his, Nucleotide Sequence
1-63 Signal peptide
70-768 mG2a(CH2-CH3) constant region
778-801 Enterokinase Linker
802-1521 Neuron Navigator 2
1522-1539 6× His Tag
Seq.413. mG2a(CH2-CH3)-EKL-NAV2(KGRLS-DTREK)-his, Amino Acid Sequence
1-21 Signal peptide
22-256 mG2a(CH2-CH3) constant region
260-267 Enterokinase Linker
268-507 Neuron Navigator 2
508-513 6× His Tag
Seq.414. mG2a(CH2-CH3)-EKL-NAV2(STNDD-DTREK)-his, Nucleotide Sequence
1-63 Signal peptide
70-768 mG2a(CH2-CH3) constant region
778-801 Enterokinase Linker
802-1521 Neuron Navigator 2
1522-1539 6× His Tag
Seq.415. mG2a(CH2-CH3)-EKL-NAV2(STNDD-DTREK)-his, Amino Acid Sequence
1-21 Signal peptide
22-256 mG2a(CH2-CH3) constant region
260-267 Enterokinase Linker
268-507 Neuron Navigator 2
508-513 6× His Tag
Seq.416. mG2a(CH2-CH3)-EKL-NAV2(SL15-DTREK)-his, Nucleotide Sequence
1-63 Signal peptide
70-768 mG2a(CH2-CH3) constant region
778-801 Enterokinase Linker
802-1551 Neuron Navigator 2
1552-1569 6× His Tag
Seq.417. mG2a(CH2-CH3)-EKL-NAV2(SL15-DTREK)-his, Amino Acid Sequence
1-21 Signal peptide
22-256 mG2a(CH2-CH3) constant region
260-267 Enterokinase Linker
268-517 Neuron Navigator 2
518-523 6× His Tag
Seq.418. His-hNPYmod(GEDAP-ESTEN)-EKL-mG2a(CH2-CH3), Nucleotide Sequence
1-63 Signal peptide
70-87 6× His Tag
88-300 hNPY modified
301-324 Enterokinase Linker
331-1029 mG2a(CH2-CH3) Constant region
Seq.419. His-hNPYmod(GEDAP-ESTEN)-EKL-mG2a(CH2-CH3), Amino Acid Sequence
1-21 Signal peptide
24-29 6× His Tag
30-100 hNPY modified
101-108 Enterokinase Linker
111-343 mG2a(CH2-CH3) Constant region
Seq.420. His-hNPYmod(PDAEG-ESTEN)-EKL-mG2a(CH2-CH3), Nucleotide Sequence
1-63 Signal peptide
70-87 6× His Tag
88-300 hNPY modified
301-324 Enterokinase Linker
331-1029 mG2a(CH2-CH3) Constant region
Seq.421. His-hNPYmod(PDAEG-ESTEN)-EKL-mG2a(CH2-CH3), Amino Acid Sequence
1-21 Signal peptide
24-29 6× His Tag
30-100 hNPY modified
101-108 Enterokinase Linker
111-343 mG2a(CH2-CH3) Constant region
Seq.422. His-hNPYmod(GEDAP-NTSEE)-EKL-mG2a(CH2-CH3), Nucleotide Sequence
1-63 Signal peptide
70-87 6× His Tag
88-300 hNPY modified
301-324 Enterokinase Linker
331-1029 mG2a(CH2-CH3) Constant region
Seq.423. His-hNPYmod(GEDAP-NTSEE)-EKL-mG2a(CH2-CH3), Amino Acid Sequence
1-21 Signal peptide
24-29 6× His Tag
30-100 hNPY modified
101-108 Enterokinase Linker
111-343 mG2a(CH2-CH3) Constant region
Seq.424. His-hNPYmod(PDAEG-STNDD)-EKL-mG2a(CH2-CH3), Nucleotide Sequence
1-63 Signal peptide
70-87 6× His Tag
88-300 hNPY modified
301-324 Enterokinase Linker
331-1029 mG2a(CH2-CH3) Constant region Seq.425. His-hNPYmod(PDAEG-STNDD)-EKL-mG2a (CH2-CH3), Amino Acid Sequence
1-21 Signal peptide
24-29 6× His Tag
30-100 hNPY modified
101-108 Enterokinase Linker
111-343 mG2a(CH2-CH3) Constant region
Seq.426. His-hNPYmod(PDAEG-tetSL15)-EKL-mG2a (CH2-CH3), Nucleotide Sequence
1-63 Signal peptide
70-87 6× His Tag
88-330 hNPY modified
331-354 Enterokinase Linker
361-1059 mG2a(CH2-CH3) Constant region
Seq.427. His-hNPYmod(PDAEG-tetSL15)-EKL-mG2a (CH2-CH3), Amino Acid Sequence
1-21 Signal peptide
24-29 6× His Tag
30-110 hNPY modified
111-118 Enterokinase Linker
121-353 mG2a(CH2-CH3) Constant region
Seq.428. mG2a(CH2-CH3)-EKL-hNPYmod(GEDAP-ESTEN)-his, Nucleotide Sequence
1-63 Signal peptide
70-768 mG2a(CH2-CH3) Constant Region
778-801 Enterokinase Linker
802-1014 hNPY modified
1015-1032 6× His Tag
Seq.429. mG2a(CH2-CH3)-EKL-hNPYmod(GEDAP-ESTEN)-his, Amino Acid sequence
1-21 Signal peptide
24-256 mG2a(CH2-CH3) Constant Region
260-267 Enterokinase Linker
268-338 hNPY modified
339-344 6× His Tag
Seq.430. mG2a(CH2-CH3)-EKL-hNPYmod(PDAEG-ESTEN)-his, Nucleotide Sequence
1-63 Signal peptide
70-768 mG2a(CH2-CH3) Constant Region
778-801 Enterokinase Linker
802-1014 hNPY modified
1015-1032 6× His Tag
Seq.431. mG2a(CH2-CH3)-EKL-hNPYmod(PDAEG-ESTEN)-his, Amino Acid Sequence
1-21 Signal peptide
24-256 mG2a(CH2-CH3) Constant Region
260-267 Enterokinase Linker
268-338 hNPY modified
339-344 6× His Tag
Seq.432. mG2a(CH2-CH3)-EKL-hNPYmod(GEDAP-NTSEE)-his, Nucleotide Sequence
1-63 Signal peptide
70-768 mG2a(CH2-CH3) Constant Region
778-801 Enterokinase Linker
802-1014 hNPY modified
1015-1032 6× His Tag
Seq.433. mG2a(CH2-CH3)-EKL-hNPYmod(GEDAP-NTSEE)-his, Amino Acid Sequence
1-21 Signal peptide
24-256 mG2a(CH2-CH3) Constant Region
260-267 Enterokinase Linker
268-338 hNPY modified
339-344 6× His Tag
Seq.434. mG2a(CH2-CH3)-EKL-hNPYmod(PDAEG-STNDD)-his, Nucleotide Sequence
1-63 Signal peptide
70-768 mG2a(CH2-CH3) Constant Region
778-801 Enterokinase Linker
802-1014 hNPY modified
1015-1032 6× His Tag
Seq.435. mG2a(CH2-CH3)-EKL-hNPYmod(PDAEG-STNDD)-his, Amino Acid Sequence
1-21 Signal peptide
24-256 mG2a(CH2-CH3) Constant Region
260-267 Enterokinase Linker
268-338 hNPY modified
339-344 6× His Tag
Seq.436. mG2a(CH2-CH3)-EKL-hNPYmod(PDAEG-tetSL15)-his, Nucleotide Sequence
1-63 Signal peptide
70-768 mG2a(CH2-CH3) Constant Region
778-801 Enterokinase Linker
802-1044 hNPY modified
1045-1062 6× His Tag
Seq.437. mG2a(CH2-CH3)-EKL-hNPYmod(PDAEG-tetSL15)-his, Amino Acid Sequence
1-21 Signal peptide
24-256 mG2a(CH2-CH3) Constant Region
260-267 Enterokinase Linker
268-348 hNPY modified
349-354 6× His Tag Retrovector constructs containing each of the SEQS 173-182, SEQs 235-244 and SEQs 398-437 are then used to transfect CHO cells and achieve stable integration and expression as previously described (U.S. Pat. Nos. 8,703,134; 8,394,379; 7,566,447; and 20130230516; each of which is incorporated herein by reference in its entirety). Other methods of expression known to the art may be used.

FIG. 16 provides a summary of the constructs for NPY and NAV2 showing the arrangement of wild type and scrambled motifs and the expected responses from individuals exposed to Zika and/or dengue. Again, similar arrangements of wild type and scrambled motifs in synthetic versions of other proteins containing antibody mediated mimics of Zika may be constructed and expressed.

A particular application of these constructs derived from NPY and NAV2, and from other mimic epitope bearing human proteins, in addition to being applied in validation of epitope mimic predictions, is to serve as a detection system for anti-Zika antibodies which have binding to these human proteins with potential adverse effect. As such the engineered human proteins with mimics and scrambled mimics serve as a tool in the detection of antibodies as a surrogate marker of probability of development of GBS or fetal syndrome or other adverse neuropathology arising from Zika infection.

The method of detection of binding of anti-Zika antibodies to the synthetic polypeptides may be any assay well known to those skilled in the art including but not limited to ELISA assays, or Western blots.

Example 9: Mimic Peptides in Non-Structural Proteins of Zika Virus

We analyzed the predicted B cell epitopes of Zika proteins in comparison with human proteome proteins which are identified as having an association with microcephaly. A sub set of the human proteome was selected based on the presence of the term "microcephaly" anywhere in the Uniprot descriptor. Based on this approach a number of matches of pentamer motifs found in flaviviruses were identified. Some matches are found very widely in all flaviviruses; these were discounted. High probability epitope mimics found in Zika virus SPH2015 are shown in Table 13

TABLE 13

| Zika protein | SEQ ID NO: | Mimic motif | Human protein target |
|---|---|---|---|
| PrM | SEQ 1334 | SSTSQ | CDKRap2 (UniProt B1AMJ5) |
| NS1 | SEQ 702 | STTAS | ASPM |
| NS3 | SEQ 1335 | RREEE | CDKRap2 (UniProt B1AMJ5) |
| NS4B | SEQ 1336 | AAQKR | ASPM |
| NS4B | SEQ 1337 | GESSS | CEP135 |

Zika virus NS1 was found to have a particularly unique match to Abnormal spindle like microcephaly associated protein (ASPM), mutations of which are highly associated with microcephaly (FIGS. 19-20).

NS1 is Immunogenic in Flaviviruses

NS1 is secreted from flaviviral infected cells as a dimer, it is released into circulation but some also remains associated with the plasma membrane of the cells. NS1 may be secreted at very high levels into serum, depending on flaviviral strain, with up to 50 ug/ml having been reported in the serum of dengue type 2 patients [55-57]. In most well understood flaviviral infections patients, non structural protein 1 (NS1) induces high levels of antibodies [58]. The presence of antibody mimic epitopes in dengue NS1 is well documented, with antibodies elicited by NS1 binding to endothelium and clotting factors [59, 60].

When we compare flaviviral predicted B cell epitopes to human proteins involved in cardiovascular functions, our observations confirm the presence of epitope mimics in dengue NS1 including B cell epitopes which elicit antibodies matching B cell epitopes in coagulation factors VII, VIII, X, vascular endothelial growth factors (VEGF), plasminogen, thrombospondin and von Willebrand (VWF) factor and others.

Figure 18:
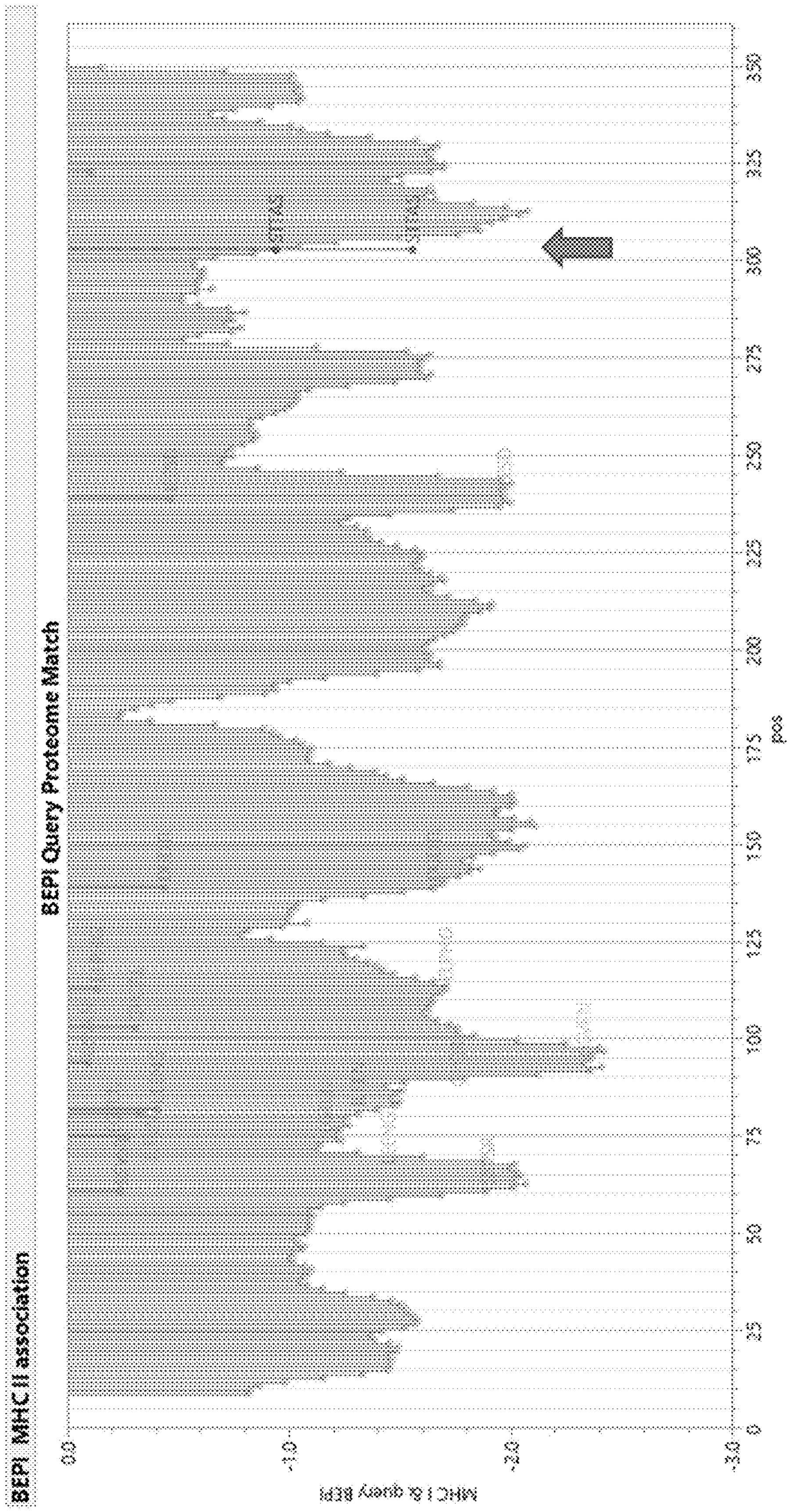

NS1 Contains a B Cell Epitope which Comprises the Motif STTAS (SEQ ID NO.: 702) and which has Strong T Cell Help Zika virus however is different from other flaviviruses in that while its NS1 does have a lesser set of mimics for VEGF and VWF than dengue, it also has a particular B cell epitope which comprises the motif STTAS (SEQ ID NO.: 702), centered at amino acid position 303 of NS1 (FIGS. 17 and 18). This motif matches an B cell epitope in human Abnormal spindle like microcephaly associated protein (ASPM) (FIG. 19). The STTAS (SEQ ID NO.: 702) motif is conserved in all NS1 and all polyproteins from all Zika isolates available to date. In particular, the motif STTAS is located on a highly exposed loop of NS1 which remains exposed even when NS1 is dimerized (FIG. 20) [61]. Adjacent to the STTAS (SEQ ID NO.: 702) motif in Zika NS1 is a sequence comprising high MEW II binding, especially for DQ alleles but also for the majority of DRB alleles, ensuring good T cell help. The corresponding B cell epitope motif is absent from other flaviviruses and, with one exception, 14 other flaviviruses examined (comprising exemplars of DEN 1-4 and YF, TBEV, JEV and WNV) have no motifs matching ASPM. The exception is WNV which has a motif RGPAA (SEQ ID NO.: 1274) centered at amino acid 296 in the NS1 loop.

NS1 proteins of Zika virus are therefore proteins which are likely secreted in large amounts, are highly immunogenic, and have a domain B cell epitope which elicits antibodies that are predicted to bind a B cell epitope on ASPM. In addition, the presence of the matching peptide motif in NS1 during replication in neurons may bind and compromise functions of ASPM directly.

Although examination of Zika virus isolates over the years shows multiple mutations in NS1, the loop comprising the motifs of interest is highly conserved, lying in a loop between multiple disulphide bonds [61].

ASPM is Associated with Microcephaly

Abnormal spindle microcephaly associated protein ASPM, otherwise known as MCPH5, is a major determinant of cortical size [62]. Homozygous recessive mutations of ASPM are the defect most commonly associated with genetic based microcephaly. Mutations in ASPM are the most frequent cause of microcephaly [63]. ASPM is preferentially expressed in the developing brain [64]. ASPM is a large protein, 3477 amino acids long which comprises two distinct regions, a N terminal region of ~869 amino acids followed by a number of higher order repeated sequences configured as IQXXXRGXXXR, which vary between isoforms and between species and occupy the C terminal half of the protein. The number of repeats appears to be linked to brain size. ASPM locates bound to the spindle with the first 960 amino acids being the tubule binding domain. The STTAS (SEQ ID NO.: 702) motif is located within this region (FIG. 21). There are multiple isoforms of ASPM, which differ in the number of higher order repeats they contain in their C terminal half.

ASPM is closely associated with the mitotic spindle and may control the symmetry of proliferation in progenitor cells. It appears to control chromosomal segregation and is essential to allow fetal stem cells to produce neurons[64]. ASPM may also control neuronal migration [65]. The role of ASPM in non-neuronal cells is less clear. No defects other than microcephaly are found in patients carrying mutations of this ASPM. Hence it only appears essential for neuronal mitogenesis.

The presence of antibodies binding ASPM would likely compromise or inhibit its function, thereby compromising its role in spindle formation and chromosome segregation, especially in neuronal cells. It is also possible that an excess of NS1 bearing the homologous peptide motif may compromise interactions with other spindle proteins.

STTAS in ASPM is Located in the Conserved Spindle Binding Region

STTAS (SEQ ID NO.: 702), the motif which corresponds to a B cell epitope in Zika NS1 is centered at amino acid 567. Notably the motif RGPAA (SEQ ID NO.: 1274), found in WNV is centered at amino acid position 27, very close to the N terminal. The motif SSTAS is also found in a B cell epitope in ASPM.

Only full length isoforms of human ASPM carry the motif uniprot.org/uniprot/Q8IZT6. STTAS (SEQ ID NO.: 702) is found in ASPM of Gorilla and chimpanzee and several other species of Old World Monkeys but not in other mammals. Macaques and Aotus carry a near neighbor motif LTTAS (SEQ ID NO.: 1275). Mice and other commonly used lab rodents do not have a similar motif, precluding direct testing of the impact of NS1 or antibodies thereto.

Uniprot Lists the Known Functions of ASPM as the Following:

cerebral cortex development
developmental growth
forebrain neuroblast division
maintenance of centrosome location
male gonad development
mitotic nuclear division negative regulation of asymmetric cell division
negative regulation of neuron differentiation
neuronal stem cell population maintenance
neuron migration
oogenesis
positive regulation of canonical Wnt signaling pathway
positive regulation of neuroblast proliferation
regulation of meiotic cell cycle
spermatogenesis
spindle assembly involved in meiosis
spindle localization
spindle organization Diagnostics Based on the NS1 Mimic Motifs:

Identification of antibodies in a pregnant woman following Zika infection, wherein said antibodies are directed to ASPM is therefore likely indicative of risk of the fetus developing microcephaly. In one embodiment therefore we provide a diagnostic test comprising the peptide STTAS (SEQ ID NO.: 702) or an extended peptide comprising this motif, comprising GPSLRSTTASGRVIE (SEQ ID NO.: 645). In addition, we provide a recombinant form of NS1 firstly comprising the wildtype motif STTAS (SEQ ID NO.: 702) and an alternate version in which this is replaced by MTTVM (SEQ ID NO.: 1276). This allows the demonstration of epitope specific binding to the motif of interest.

We further provide a synthetic polypeptide derived from ASPM which may identify antibodies elicited in response to Zika NS1. As controls we also provide two such polypeptides, one with a scrambled motif and one in which the Zika motif is replaced by a Yellow fever motif. It will be recognized by those skilled in the art that the immediate context of the mimic motifs is of importance but that the length of the surrounding polypeptide is selected for convenience and that various mutant or scrambled motifs may be designed. Hence the examples in Table 14 below are not considered limiting.

protection by antibodies to NS1 are reported for West Nile virus [68]. The presence of adverse motifs in NS1 is therefore of concern and must be understood before vaccine comprising NS1 of Zika is developed.

To overcome this concern, in one embodiment of the present invention we provide synthetic versions of NS1, or apportion thereof, in which the STTAS (SEQ ID NO.: 702) mimic is replaced. Such polypeptides may be designed to contain other motifs, hence the example shown is not limiting. Furthermore, such a NS1 based vaccine may be formulated as a protein, a protein fusion, a component of a chimera, a virus like particle or as a nucleotide sequence. In one particular embodiment shown below we express the synthetic polypeptide of NS1 as an immunoglobulin Fc-fusion.

Seq.438. NS1-EKL-hG1(CH2-CH3), Nucleotide Sequence
1-60 Signal peptide
61-1152 NS1
1153-1176 Enterokinase Linker
1177-1881 hG1(CH2-CH3) Constant region Seq.439. NS1-EKL-hG1(CH2-CH3), Amino Acid Sequence
1-20 Signal peptide
21-384 NS1
385-392 Enterokinase Linker
393-627 hG1(CH2-CH3) Constant region Seq.440. NS1_M4-EKL-hG1(CH2-CH3), Nucleotide Sequence
1-60 Signal peptide
61-1152 NS1 M4 mutant
1153-1176 Enterokinase Linker
1177-1881 hG1(CH2-CH3) Constant region Seq.441. NS1_M4-EKL-hG1(CH2-CH3), Amino Acid Sequence
1-20 Signal peptide
21-384 NS1 M4 mutant
385-392 Enterokinase Linker
393-627 hG1(CH2-CH3) Constant region Seq.442. NS1_Partial-EKL-hG1(CH2-CH3), Nucleotide Sequence
1-60 Signal peptide
61-639 NS1 partial
640-663 Enterokinase Linker
664-1368 hG1(CH2-CH3) Constant region

TABLE 14

Synthetic peptides and polyproteins of utility in detection of antibodies to NS1:

| SEQ ID NO: | Sequence | Utility |
|---|---|---|
| 1239 | STTAS | detection |
| 1240 | GPSLRSTTASGRVIE | detection |
| 1241 | GPSLRMTMVSGRVIE | Control |
| 1242 | SAVGEHEKVINNQKEKEDFHSYLPIIDPILSKSKSYKNEVTPS<u>STTA</u><u>S</u>VARKRKSDGMEDANVRVAITEHTEVREIKRIHFSPSEP | ASPM detection |
| 1243 | SAVGEHEKVINNQKEKEDFHSYLPIIDPILSKSKSYKNEVTPS<u>MTM</u><u>VS</u>VARKRKSDGMEDANVRVAITEHTEVREIKRIHFSPSEP | ASPM control |
| 1244 | SAVGEHEKVINNQKEKEDFHSYLPIIDPILSKSKSYKNEVTPS<u>STTD</u><u>S</u>VARKRKSDGMEDANVRVAITEHTEVREIKRIHFSPSEP | Yellow fever control |

NS1 Based Vaccines

The majority of vaccines designed to combat flaviviruses have utilized the envelope and membrane proteins. However, concerns regarding incomplete understanding of antibody interactions between serotypes of dengue have led to the evaluation of dengue vaccines comprising the NS1 protein [66, 67]. These have included DNA vaccines which have demonstrated capability to raise high levels of anti-NS1 antibody in mice, which is itself partially protective following passive transfer. Similar observations of passive Seq.443. NS1_Partial-EKL-hG1(CH2-CH3), Amino Acid Sequence 1-20 Signal peptide
21-213 NS1 partial
214-221 Enterokinase Linker
222-456 hG1(CH2-CH3) Constant region Seq.444. NS1_M4_Partial-EKL-hG1(CH2-CH3), Nucleotide Sequence 1-60 Signal peptide
61-639 NS1_M4 partial
640-663 Enterokinase Linker
664-1368 hG1(CH2-CH3) Constant region Seq.445. NS1_M4_Partial-EKL-hG1(CH2-CH3), Amino Acid Sequence 1-20 Signal peptide
21-213 NS1_M4 partial
214-221 Enterokinase Linker
222-456 hG1(CH2-CH3) Constant region

Example 10: Development of Serodiagnostic Kits to Differentiate Flavivirus Infections As a broader understanding of the spread and co-endemnicity of Zika virus has emerged, the need for a specific serologic diagnostic kit which can differentiate not only antibodies from infection with Zika from those arising from infections with dengue serotypes and yellow fever, but also from chikungunya and West Nile virus has become apparent. There is also utility to being able to differentiate IgG and IgM responses. With this goal we further evaluated the high probability B cell epitopes in exemplars each of these viruses and selected 6-15 pentamer B cell epitopes for each envelope protein and each NS1 protein. The 15 mer peptides within which these pentamers form the central five amino acids were also recorded. In the case of chikungunya 8 15mer peptides, each comprising a high probability B cell epitope pentamers were selected from the E2 protein. These peptides (the "diagnostic set") can be used singly in an array, or as a pool for each virus, to identify antibodies to each of these viruses and to differentiate from antibodies to the other viruses in the diagnostic set.

For each virus a representative a set of isolates was then assembled, comprising 20→200 isolates for each virus. These included both polyproteins and envelope sequences, and polyproteins and NS1 proteins as shown in Table 15, as well as 30 isolates of chikungunya virus. These sets of proteins sequences were curated to ensure they were complete, or near complete, sequences and to exclude any duplicate isolates. The resultant database of sequences for each virus was interrogated by the diagnostic set of epitope pentamers to determine how conserved each of the selected pentamers is across all isolates of the same or other flaviviruses and chikungunya and to identify any potential cross reactions. This process was repeated for both pentamers derived from the envelope proteins and for pentamers derived from NS1. The results are shown in Table 16 and 17 and in FIGS. 22 and 23. A further small set of pan-dengue or pan-flavi pentamer peptides were identified as comprising B cell epitopes which are present in either all dengue isolates or in all flaviviruses and which may therefore have utility in identifying exposure to the virus family. These analyses were subsequently extended to include Usutu virus as shown in Table 33 below

TABLE 15

Tally of envelope and NS1 searched for cross reacting motifs

| | Downloaded from VIPR | Source | Species of origin | Curated * |
|---|---|---|---|---|
| Dengue type1 | 254 polyprotein and Envelope 95 polyprotein and NS1 | S America | Human | 192 envelope 74NS1 |
| Dengue type 2 | 357 polyprotein and Envelope 129 polyprotein and NS1 | S America | Human | 215 envelope 107 NS1 |
| Dengue type 3 | 309 polyprotein and Envelope 203 polyprotein and NS1 | S America | Human | 208 envelope 160 NS1 |
| Dengue type 4 | 495 polyprotein and Envelope 39 polyprotein and NS1 | S America | Human | 433 envelope 29 NS1 |
| Yellow fever | 71 polyprotein and Envelope 82 polyprotein and NS1 | All countries | All isolates | 48 envelope 72 NS1 |
| WNV | 714 polyprotein and Envelope 82 polyprotein and NS1 | North and South America | Human | 51 envelope 52 NS1 |
| Zika | 154 polyprotein and Envelope 61 polyprotein and NS1 | Americas French Polynesia | Human | 41 envelope 47 NS1 |
| Chikungunya | 46 E2 protein | Americas | All | 30 E2 |

In addition to providing specific differentiation between antibodies arising from an infection with Zika and the related flaviviruses, it is important to differentiate binding by antibodies to other potentially co-circulating microorganisms. We thus assembled datasets of sequences from several other organisms of interest including Saint Louis encephalitis virus, Japanese encephalitis, hepatitis C, human parvovirus 19, human enteroviruses groups A-J, Ross River virus, Easter equine encephalitis, and malaria. The sequences were curated to ensure complete or near complete sequences and no duplication of isolates. The numbers of curated sequences are shown in the initial rows of Tables 18 and 19. We then interrogated these datasets with the diagnostic set of pentamer peptides to determine if the pentamers are also found in these organisms. A determination was made of presence or absence of the pentamers, but not a determination of whether the peptide of interest in the target protein occurred in a B cell epitope within that protein. In addition, we did not evaluate the timing/life stage of protein transcription for each organism. Hence an overestimate of potential antibody cross reactions was made. Very few cross reactions were found except for a few for dengue with the other flaviviruses. Some potential cross reactivity due to pentamers in common with *Plasmodium falciparum* was noted. *Plasmodium* comprises a large, >5300 protein, proteome. The results are shown in Tables 18 and 19 and in FIGS. 24 and 25

These analyses were subsequently extended to include Usutu virus as shown in Table 33 below

TABLE 16

Specificity of selected envelope peptides between flaviviruses and chikungunya

| Column | BEPI | pos | Flanks | BEPIpent | DEN1 | DEN2 | DEN3 | DEN4 | YF | WNV | ZIKV | CHIK |
|---|---|---|---|---|---|---|---|---|---|---|---|---|
| DEN1 | −1.04 | 51 | ELLKTEVTNPAVLRK SEQ 446 | EVTNP SEQ 519 | 186 | 0 | 0 | 0 | 0 | 0 | 0 | 0 |
| DEN1 | −1.84 | 168 | IATITPQAPTSEIQL SEQ 447 | PQAPT SEQ 520 | 187 | 0 | 0 | 0 | 0 | 0 | 0 | 0 |

TABLE 16-continued

Specificity of selected envelope peptides between flaviviruses and chikungunya

| Column | BEPI | pos | Flanks | BEPIpent | DEN1 | DEN2 | DEN3 | DEN4 | YF | WNV | ZIKV | CHIK |
|---|---|---|---|---|---|---|---|---|---|---|---|---|
| DEN1 | -2.09 | 227 | WTSGASTSQETWNRQ SEQ 448 | STSQE SEQ 521 | 188 | 0 | 0 | 0 | 0 | 0 | 0 | 0 |
| DEN1 | -1.57 | 272 | TGATEIQTSGTTTIF SEQ 449 | IQTSG SEQ 522 | 192 | 0 | 3 | 0 | 0 | 0 | 0 | 0 |
| DEN1 | -1.55 | 329 | VQVKYEGTDAPCKIP SEQ 450 | EGTDA SEQ 523 | 190 | 0 | 0 | 0 | 0 | 0 | 0 | 0 |
| DEN1 | -1.77 | 344 | FLTQDEKGVTQNGRL SEQ 451 | EKGVT SEQ 524 | 185 | 0 | 0 | 0 | 0 | 0 | 0 | 0 |
| DEN1 | -0.99 | 361 | ANPIVTDKEKPVNIE SEQ 452 | TDKEK SEQ 525 | 191 | 0 | 0 | 0 | 0 | 0 | 0 | 0 |
| DEN1 | -1.55 | 371 | PVNIETEPPFGESYI SEQ 453 | TEPPF SEQ 526 | 191 | 0 | 0 | 0 | 0 | 0 | 0 | 0 |
| DEN2 | -1.65 | 226 | WLPGADTQGSNWIQK SEQ 454 | DTQGS SEQ527 | 0 | 215 | 0 | 0 | 0 | 0 | 0 | 0 |
| DEN2 | -1.13 | 228 | PGADTQGSNWIQKET SEQ 455 | QGSNW SEQ 528 | 0 | 215 | 0 | 0 | 0 | 0 | 0 | 0 |
| DEN2 | -1.44 | 244 | VTFKNPHAKKQDVVV SEQ 456 | PHAKK SEQ 529 | 0 | 215 | 0 | 0 | 0 | 0 | 0 | 0 |
| DEN2 | -1.74 | 328 | IRVQYEGDGSPCKIP SEQ 457 | EGDGS SEQ 530 | 0 | 215 | 0 | 0 | 0 | 0 | 0 | 0 |
| DEN2 | -1.27 | 330 | VQYEGDGSPCKIPFE SEQ 458 | DGSPC SEQ 531 | 0 | 215 | 0 | 0 | 0 | 0 | 0 | 0 |
| DEN2 | -1.28 | 362 | PIVTEKDSPVNIEAE SEQ459 | KDSPV SEQ 532 | 0 | 212 | 0 | 0 | 0 | 0 | 0 | 0 |
| DEN2 | -1.53 | 370 | PVNIEAEPPFGDSYI SEQ 460 | AEPPF SEQ 533 | 1 | 215 | 208 | 0 | 0 | 0 | 0 | 0 |
| DEN2 | -1.14 | 372 | NIEAEPPFGDSYIIV SEQ 461 | PPFGD SEQ 534 | 0 | 215 | 0 | 433 | 48 | 0 | 0 | 0 |
| DEN3 | -1.49 | 154 | QHQVGNETQGVTAEI SEQ 462 | NETQG SEQ 535 | 0 | 0 | 206 | 0 | 0 | 0 | 0 | 0 |
| DEN3 | -2.03 | 224 | WTSGATTETPTWNRK SEQ 463 | TTETP SEQ 536 | 0 | 0 | 205 | 0 | 0 | 0 | 0 | 0 |
| DEN3 | -1.63 | 269 | TGATEIQNSGGTSIF SEQ 464 | IQNSG SEQ 537 | 0 | 0 | 203 | 0 | 0 | 0 | 0 | 0 |
| DEN3 | -1.63 | 311 | VLKKEVSETQHGTIL SEQ 465 | VSETQ SEQ 538 | 0 | 0 | 208 | 0 | 0 | 0 | 0 | 0 |
| DEN3 | -1.24 | 327 | KVEYKGEDAPCKIPF SEQ 466 | GEDAP SEQ 539 | 0 | 0 | 145 | 0 | 0 | 0 | 0 | 0 |
| DEN3 | -1.02 | 327 | KVEYKGEDVPCKIPF SEQ 467 | GEDVP SEQ 540 | 0 | 0 | 62 | 0 | 0 | 0 | 0 | 0 |
| DEN3 | -1.31 | 336 | PCKIPFSTEDGQGKA SEQ 468 | FSTED SEQ 541 | 0 | 0 | 208 | 0 | 0 | 0 | 0 | 0 |
| DEN3 | -1.17 | 360 | PVVTKKEEPVNIEAE SEQ 469 | KEEPV SEQ 542 | 0 | 0 | 191 | 0 | 0 | 0 | 0 | 0 |
| DEN3 | -1.57 | 369 | VNIEAEPPFGESNIV SEQ 470 | EPPFG SEQ 543 | 192 | 215 | 208 | 433 | 0 | 0 | 0 | 0 |
| DEN4 | -1.18 | 48 | DFELTKTTAKEVALL SEQ 471 | KTTAK SEQ 544 | 0 | 0 | 0 | 431 | 0 | 0 | 0 | 0 |
| DEN4 | -1.68 | 155 | HAVGNDTSNHGVTAT SEQ 472 | DTSNH SEQ 545 | 0 | 0 | 0 | 430 | 0 | 0 | 0 | 0 |
| DEN4 | -1.59 | 166 | VTATITPRSPSVEVE SEQ 473 | TPRSP SEQ 546 | 0 | 0 | 0 | 433 | 0 | 0 | 0 | 0 |
| DEN4 | -1.62 | 272 | GATEVDSGDGNHMFA SEQ 474 | DSGDG SEQ 547 | 0 | 0 | 0 | 424 | 0 | 0 | 0 | 0 |
| DEN4 | -1.29 | 315 | DKEMAETQHGTTVVK SEQ 475 | ETQHG SEQ 548 | 192 | 215 | 208 | 433 | 0 | 0 | 0 | 0 |
| DEN4 | -1.44 | 328 | VKVKYEGAGAPCKVP SEQ 476 | EGAGA SEQ 549 | 0 | 0 | 0 | 431 | 0 | 0 | 0 | 0 |
| DEN4 | -1.06 | 358 | ISSIPLAENTNSVTN SEQ 477 | LAENT SEQ 550 | 0 | 0 | 0 | 431 | 0 | 0 | 0 | 0 |
| DEN4 | -1.05 | 362 | PLAENTNSVTNIELE SEQ 478 | TNSVT SEQ 551 | 0 | 0 | 0 | 423 | 0 | 0 | 0 | 0 |
| PAN DEN | | 313 | | ETQHG SEQ 552 | 192 | 215 | 208 | 433 | 0 | 0 | 0 | 0 |
| PAN DEN | | 369 | | EPPFG SEQ 553 | 192 | 215 | 208 | 433 | 0 | 51 | 0 | 0 |
| PAN DEN | | 99 | | DRGWG SEQ 554 | 192 | 215 | 208 | 433 | 48 | 50 | 41 | 0 |
| PAN DEN | | 185 | | SPRTG SEQ 555 | 192 | 215 | 207 | 0 | 0 | 0 | 0 | 0 |
| PAN DEN | | 404 | | TARGA SEQ 556 | 192 | 0 | 207 | 0 | 0 | 0 | 0 | 0 |
| PAN DEN | | 394 | | GSSIG SEQ 557 | 192 | 214 | 208 | 433 | 48 | 51 | 0 | 0 |
| PAN DEN | | 74 | | RCPTQ SEQ 558 | 192 | 215 | 208 | 433 | 0 | 0 | 41 | 0 |
| PAN DEN | | 370 | | PPFGD SEQ 559 | 0 | 215 | 0 | 433 | 48 | 51 | 41 | 0 |
| YF | -1.04 | 52 | ETVAIDRPAEVRKVC SEQ 479 | DRPAE SEQ 560 | 0 | 0 | 0 | 0 | 4 | 0 | 0 | 0 |
| YF | -1.25 | 150 | HVGAKQENWNTDIKT SEQ 480 | QENWN SEQ 561 | 0 | 0 | 0 | 0 | 39 | 0 | 0 | 0 |
| YF | -1.22 | 165 | LKFDALSGSQEVEFI SEQ 481 | LSGSQ SEQ 562 | 0 | 0 | 0 | 0 | 48 | 0 | 0 | 0 |
| YF | -1.08 | 218 | DLTLPWQSGSGGVWR SEQ 482 | WQSGS SEQ 563 | 0 | 0 | 0 | 0 | 48 | 0 | 0 | 0 |
| YF | -1.50 | 250 | VLALGNQEGSLKTAL SEQ 483 | NQEGS SEQ 564 | 0 | 0 | 0 | 0 | 44 | 0 | 0 | 0 |
| YF | -1.73 | 267 | AMRVTKDTNDNNLYK SEQ 484 | KDTND SEQ 565 | 0 | 0 | 0 | 0 | 25 | 0 | 0 | 0 |
| YF | -2.21 | 311 | FFVKNPTDTGHGTVV SEQ 485 | PTDTG SEQ 566 | 0 | 0 | 0 | 0 | 47 | 0 | 0 | 0 |
| YF | -1.30 | 358 | VNPIASTNDDEVLIE SEQ 486 | STNDD SEQ 567 | 0 | 0 | 0 | 0 | 46 | 0 | 0 | 0 |
| YF | -1.61 | 356 | VTVNPIASTNDDEVL SEQ 487 | IASTN SEQ 568 | 0 | 0 | 0 | 0 | 48 | 0 | 0 | 0 |
| YF | -1.03 | 369 | VLIEVNPPFGDSYII SEQ 488 | NPPFG SEQ 569 | 0 | 0 | 0 | 0 | 48 | 0 | 0 | 0 |
| WNV | -1.52 | 38 | TIMSKDKPTIDVKMM SEQ 489 | DKPTI SEQ 1247 | 0 | 0 | 0 | 0 | 0 | 49 | 0 | 0 |
| WNV | -1.11 | 148 | FVHGPTTVESHGKIG SEQ 490 | TTVES SEQ 1248 | 0 | 0 | 0 | 0 | 0 | 51 | 0 | 0 |
| WNV | -1.21 | 188 | VTVDCEPRSGIDTSA SEQ 491 | EPRSG SEQ 1249 | 0 | 0 | 0 | 433 | 0 | 51 | 0 | 0 |
| WNV | -1.07 | 253 | SVVALGSQEGALHQA SEQ 492 | GSQEG SEQ 1250 | 192 | 215 | 208 | 432 | 0 | 51 | 40 | 0 |
| WNV | -0.81 | 295 | EKLQLKGTTYGVCSK SEQ 493 | KGTTY SEQ 1251 | 0 | 0 | 0 | 0 | 0 | 51 | 0 | 0 |
| WNV | -1.86 | 312 | KFARTPADTGHGTVV SEQ 494 | PADTG SEQ 1252 | 0 | 0 | 0 | 0 | 0 | 51 | 0 | 0 |
| WNV | -1.50 | 327 | LELQYTGTDGPCKVP SEQ 495 | TGTDG SEQ 1253 | 0 | 0 | 0 | 0 | 0 | 49 | 0 | 0 |
| WNV | -0.90 | 385 | YIVVGRGEQQINHHW SEQ 496 | RGEQQ SEQ 1254 | 0 | 0 | 0 | 0 | 0 | 51 | 0 | 0 |
| ZIKV | -0.62 | 16 | DFVEGMSGGTWVDIV SEQ 497 | MSGGT SEQ 1255 | 0 | 0 | 0 | 0 | 0 | 0 | 41 | 0 |
| ZIKV | -1.21 | 38 | TVMAQDKPTVDIELV SEQ 498 | DKPTV SEQ 1256 | 0 | 0 | 0 | 0 | 0 | 0 | 41 | 0 |
| ZIKV | -1.41 | 86 | AYLDKQSDTQYVCKR SEQ 499 | QSDTQ SEQ 570 | 0 | 0 | 0 | 0 | 0 | 0 | 41 | 0 |
| ZIKV | -1.37 | 128 | SKKMTGKSIQPENLE SEQ 500 | GKSIQ SEQ 571 | 0 | 0 | 0 | 0 | 0 | 0 | 41 | 0 |

TABLE 16-continued

Specificity of selected envelope peptides between flaviviruses and chikungunya

| Column | BEPI | pos | Flanks | BEPIpent | DEN1 | DEN2 | DEN3 | DEN4 | YF | WNV | ZIKV | CHIK |
|---|---|---|---|---|---|---|---|---|---|---|---|---|
| ZIKV | -0.84 | 145 | IMLSVHGSQHSGMIV SEQ 501 | HGSQH SEQ 572 | 0 | 0 | 0 | 0 | 0 | 0 | 41 | 0 |
| ZIKV | -2.20 | 159 | VNDTGHETDENRAKV SEQ 502 | HETDE SEQ 573 | 0 | 0 | 0 | 0 | 0 | 0 | 41 | 0 |
| ZIKV | -2.01 | 172 | KVEITPNSPRAEATL SEQ 503 | PNSPR SEQ 574 | 0 | 0 | 0 | 0 | 0 | 0 | 41 | 0 |
| ZIKV | -1.70 | 175 | ITPNSPRAEATLGGF SEQ 504 | PRAEA SEQ 575 | 0 | 0 | 0 | 0 | 0 | 0 | 41 | 0 |
| ZIKV | -1.55 | 233 | AGADTGTPHWNNKEA SEQ 505 | GTPHW SEQ 576 | 0 | 0 | 0 | 0 | 0 | 0 | 41 | 0 |
| ZIKV | -1.47 | 282 | EMDGAKGRLSSGHLK SEQ 506 | KGRLS SEQ 577 | 0 | 0 | 0 | 0 | 0 | 0 | 41 | 0 |
| ZIKV | -1.56 | 335 | EVQYAGTDGPCKVPA SEQ 507 | GTDGP SEQ 578 | 0 | 0 | 0 | 0 | 0 | 50 | 40 | 0 |
| ZIKV | -1.14 | 365 | ITANPVITESTENSK SEQ 508 | VITES SEQ 579 | 0 | 0 | 0 | 0 | 0 | 0 | 41 | 0 |
| ZIKV | -1.51 | 368 | NPVITESTENSKMML SEQ 509 | ESTEN SEQ 580 | 0 | 0 | 0 | 0 | 0 | 0 | 41 | 0 |
| ZIKV | -1.05 | 370 | VTTESTENSKMMLEL SEQ 510 | TENSK SEQ 581 | 0 | 0 | 0 | 0 | 0 | 0 | 41 | 0 |
| CHIK | -1.14 | 40 | ALERIRNEATDGTLK SEQ 511 | RNEAT SEQ 582 | 0 | 0 | 0 | 0 | 0 | 0 | 0 | 30 |
| CHIK | -1.21 | 144 | GREKFHSRPQHGKEL SEQ 512 | HSRPQ SEQ 583 | 0 | 0 | 0 | 0 | 0 | 0 | 0 | 30 |
| CHIK | -1.18 | 249 | VPRNAELGDRKGKIH SEQ 513 | EFGDR SEQ 584 | 0 | 0 | 0 | 0 | 0 | 0 | 0 | 30 |
| CHIK | -1.46 | 274 | RVPKARNPTVTYGKN SEQ 514 | RNPTV SEQ 585 | 0 | 0 | 0 | 0 | 0 | 0 | 0 | 30 |
| CHIK | -1.14 | 276 | PKARNPTVTYGKNQV SEQ 515 | PTVTY SEQ 586 | 0 | 0 | 0 | 0 | 0 | 0 | 0 | 30 |
| CHIK | -1.27 | 303 | SYRNMGEEPNYQEEW SEQ 516 | GEEPN SEQ 587 | 0 | 0 | 0 | 0 | 0 | 0 | 0 | 30 |
| CHIK | -0.70 | 334 | EVTWGNNEPYKYWPQ SEQ 517 | NNEPY SEQ 588 | 0 | 0 | 0 | 0 | 0 | 0 | 0 | 30 |
| CHIK | -1.33 | 347 | PQLSTNGTAHGHPHE SEQ 518 | NGTAH SEQ 589 | 0 | 0 | 0 | 0 | 0 | 0 | 0 | 30 |

TABLE 17

Specificity of selected NS1 peptides between flaviviruses and chikungunya

| Column | Pep # | BEPI | pos | Flanks | BepiPent | DEN1 | DEN2 | DEN3 | DEN4 | WNV | YF | ZIKV |
|---|---|---|---|---|---|---|---|---|---|---|---|---|
| DEN1 | 1 | -1.45 | 38 | YKFQADSPKRLSAAI SEQ 590 | DSPKR SEQ 647 | 74 | 0 | 160 | 0 | 0 | 0 | 0 |
| DEN1 | 2 | -0.75 | 104 | AQGKKMIRPQPMEHK SEQ 591 | MIRPQ SEQ 648 | 70 | 0 | 0 | 0 | 0 | 0 | 0 |
| DEN1 | 3 | -1.84 | 141 | IDGPDTPECPDGQRA SEQ 592 | TPECP SEQ 649 | 73 | 0 | 160 | 0 | 0 | 0 | 0 |
| DEN1 | 4 | -1.27 | 144 | PDTPECPDGQRAWNI SEQ 593 | CPDGQ SEQ 650 | 43 | 0 | 0 | 0 | 0 | 0 | 0 |
| DEN1 | 5 | -0.94 | 190 | MSAAIKDSKAVHADM SEQ 594 | KDSKA SEQ 651 | 74 | 0 | 0 | 0 | 0 | 0 | 0 |
| DEN1 | 6 | -1.17 | 206 | YWIESEKNETWKLAR SEQ 595 | EKNET SEQ 652 | 74 | 0 | 0 | 0 | 0 | 0 | 0 |
| DEN1 | 7 | -1.46 | 294 | DEHCGNRGPSLRTTT SEQ 596 | NRGPS SEQ 653 | 47 | 108 | 0 | 0 | 0 | 0 | 0 |
| DEN1 | 8 | -0.81 | 301 | GPSLRTTTVTGKIIH SEQ 597 | TTTVT SEQ 654 | 74 | 0 | 0 | 0 | 0 | 0 | 0 |
| DEN2 | 1 | -1.50 | 39 | KFQPESPSKLASAIQ SEQ 598 | SPSKL SEQ 655 | 0 | 107 | 0 | 0 | 0 | 0 | 0 |
| DEN2 | 2 | -2.00 | 105 | AGKRSLRPQPTELKY SEQ 599 | LRPQP SEQ 656 | 0 | 105 | 0 | 0 | 0 | 0 | 0 |
| DEN2 | 3 | -1.15 | 126 | KAKMLSTESHNQTFL SEQ 600 | STESH SEQ 657 | 0 | 97 | 0 | 0 | 0 | 0 | 0 |
| DEN2 | 4 | -1.43 | 142 | DGPETAECPNTNRAW SEQ 601 | AECPN SEQ 658 | 0 | 106 | 0 | 0 | 0 | 0 | 0 |
| DEN2 | 5 | -0.83 | 191 | SAAIKDNRAVHADMG SEQ 602 | DNRAV SEQ 659 | 0 | 106 | 0 | 0 | 0 | 0 | 0 |
| DEN2 | 6 | -1.03 | 248 | IIPKNFAGPVSQHNY SEQ 603 | FAGPV SEQ 660 | 0 | 105 | 0 | 0 | 0 | 0 | 0 |
| DEN2 | 7 | -1.02 | 262 | YRPGYHTQTAGPWHL SEQ 604 | HTQTA SEQ 661 | 0 | 105 | 159 | 0 | 0 | 0 | 0 |
| DEN2 | 8 | -1.37 | 291 | VVVTEDCGNRGPSLR SEQ 605 | DCGNR SEQ 662 | 0 | 106 | 0 | 0 | 0 | 0 | 0 |
| DEN3 | 1 | -1.40 | 37 | QYKFQADSPKRLATA SEQ 606 | ADSPK SEQ 663 | 74 | 0 | 160 | 0 | 0 | 0 | 0 |
| DEN3 | 2 | -1.33 | 103 | LKQGKRTLTPQPMEL SEQ 607 | RTLTP SEQ 664 | 0 | 0 | 158 | 0 | 0 | 0 | 0 |
| DEN3 | 3 | -1.80 | 140 | IIDGPNTPECPSASR SEQ 608 | NTPEC SEQ 665 | 1 | 0 | 157 | 0 | 0 | 0 | 0 |
| DEN3 | 4 | -0.90 | 190 | MSAAVKDERAVHADM SEQ 609 | KDERA SEQ 666 | 0 | 0 | 159 | 0 | 0 | 0 | 0 |
| DEN3 | 5 | -1.32 | 207 | WIESQKNGSWKLEKA SEQ 610 | KNGSW SEQ 667 | 0 | 0 | 160 | 0 | 0 | 0 | 0 |
| DEN3 | 6 | -1.11 | 257 | ISQHNHRPGYHTQTA SEQ 611 | HRPGY SEQ 668 | 0 | 0 | 141 | 0 | 0 | 0 | 0 |
| DEN3 | 7 | -0.86 | 290 | TVVITENCGTRGPSL SEQ 612 | ENCGT SEQ 669 | 0 | 0 | 160 | 0 | 0 | 0 | 0 |
| DEN3 | 8 | -0.86 | 301 | GPSLRTTTVSGKLIH SEQ 613 | TTTVS SEQ 670 | 0 | 0 | 160 | 0 | 0 | 0 | 0 |
| DEN4 | 1 | -1.18 | 39 | KFQPESPARLASAIL SEQ 614 | SPARL SEQ 671 | 0 | 0 | 0 | 29 | 0 | 0 | 0 |
| DEN4 | 2 | -1.63 | 104 | TKGKRALTPPVSDLK SEQ 615 | ALTPP SEQ 672 | 0 | 0 | 0 | 26 | 0 | 0 | 0 |
| DEN4 | 3 | -1.07 | 125 | GKAKIFTPEARNSTF SEQ 616 | FTPEA SEQ 673 | 0 | 0 | 0 | 28 | 0 | 0 | 0 |
| DEN4 | 4 | -1.81 | 140 | LIDGPDTSECPNERR SEQ 617 | DTSEC SEQ 674 | 0 | 0 | 0 | 29 | 0 | 0 | 0 |
| DEN4 | 5 | -1.25 | 207 | WIESSKNQTWQIEKA SEQ 618 | KNQTW SEQ 675 | 0 | 0 | 0 | 29 | 0 | 0 | 0 |
| DEN4 | 6 | -1.20 | 248 | LIPKSYAGPFSQHNY SEQ 619 | YAGPF SEQ 676 | 0 | 0 | 0 | 28 | 0 | 0 | 0 |
| DEN4 | 7 | -1.01 | 260 | HNYRQGYATQTVGPW SEQ 620 | GYATQ SEQ 677 | 0 | 0 | 0 | 29 | 0 | 0 | 0 |
| DEN4 | 8 | -1.19 | 292 | TIQEDCDHRGPSLRT SEQ 621 | CDHRG SEQ 678 | 0 | 0 | 0 | 29 | 0 | 0 | 0 |
| WNV | 1 | -1.69 | 38 | RYKYYPETPQGLAKI SEQ 622 | PETPQ SEQ 679 | 0 | 0 | 0 | 0 | 52 | 0 | 0 |
| WNV | 2 | -1.16 | 102 | GMYKSAPKRLTATTE SEQ 623 | APKRL SEQ 680 | 0 | 0 | 0 | 0 | 51 | 0 | 0 |
| WNV | 3 | -1.43 | 144 | GPETKECPTQNRAWN SEQ 624 | ECPTQ SEQ 681 | 0 | 0 | 0 | 0 | 51 | 0 | 0 |
| WNV | 4 | -1.74 | 177 | KVRESNTTECDSKII SEQ 625 | NTTEC SEQ 682 | 0 | 0 | 0 | 0 | 52 | 0 | 0 |
| WNV | 5 | -1.47 | 261 | HNRRPGYKTQNQGPW SEQ 626 | GYKTQ SEQ 683 | 0 | 0 | 0 | 0 | 52 | 0 | 0 |
| WNV | 6 | -1.90 | 266 | GYKTQNQGPWDEGRV SEQ 627 | NQGPW SEQ 684 | 0 | 0 | 0 | 0 | 52 | 0 | 0 |
| WNV | 7 | -1.67 | 297 | SCGHRGPATRTTTES SEQ 628 | GPATR SEQ 685 | 0 | 0 | 0 | 0 | 52 | 0 | 0 |
| WNV | 8 | -1.54 | 303 | PATRTTTESGKLITD SEQ 629 | TTESG SEQ 686 | 0 | 0 | 0 | 0 | 51 | 0 | 0 |
| YF | 1 | -1.21 | 35 | LNKYSYYPEDPVKLA SEQ 630 | YYPED SEQ 687 | 0 | 0 | 0 | 0 | 0 | 72 | 0 |
| YF | 2 | -1.41 | 140 | IIDGKSRKECPFSNR SEQ 631 | SRKEC SEQ 688 | 0 | 0 | 0 | 0 | 0 | 72 | 0 |

TABLE 17-continued

Specificity of selected NS1 peptides between flaviviruses and chikungunya

| Column | Pep # | BEPI | pos | Flanks | | BepiPent | | DEN1 | DEN2 | DEN3 | DEN4 | WNV | YF | ZIKV |
|---|---|---|---|---|---|---|---|---|---|---|---|---|---|---|
| YF | 3 | −2.21 | 193 | AVNGKKSAHGSPTFW | SEQ 632 | KSAHG | SEQ 689 | 0 | 0 | 0 | 0 | 0 | 72 | 0 |
| YF | 4 | −1.12 | 234 | LTHTIGTSVEESEMF | SEQ 633 | GTSVE | SEQ 690 | 0 | 0 | 0 | 0 | 0 | 72 | 0 |
| YF | 5 | −1.05 | 264 | PGYKVQTNGPWMQVP | SEQ 634 | QTNGP | SEQ 691 | 0 | 0 | 0 | 0 | 0 | 72 | 0 |
| YF | 6 | −2.05 | 295 | GNCDGRGKSTRSTTD | SEQ 635 | RGKST | SEQ 692 | 0 | 0 | 0 | 0 | 0 | 71 | 0 |
| YF | 7 | −2.15 | 301 | GKSTRSTTDSGKVIP | SEQ 636 | STTDS | SEQ 693 | 0 | 0 | 0 | 0 | 0 | 72 | 0 |
| YF | 8 | −1.15 | 338 | PMEIRPRKTHESHLV | SEQ 637 | PRKTH | SEQ 694 | 0 | 0 | 0 | 0 | 0 | 50 | 0 |
| ZIKV | 1 | −1.55 | 14 | VDFSKKETRCGTGVF | SEQ 638 | KETRC | SEQ 695 | 0 | 0 | 0 | 0 | 0 | 0 | 47 |
| ZIKV | 2 | −1.62 | 38 | DRYKYHPDSPRRLAA | SEQ 639 | HPDSP | SEQ 696 | 0 | 0 | 0 | 0 | 0 | 0 | 47 |
| ZIKV | 3 | −1.06 | 130 | HFVRAAKTNNSFVVD | SEQ 640 | AKTNN | SEQ 697 | 0 | 0 | 0 | 0 | 0 | 0 | 47 |
| ZIKV | 4 | −1.23 | 193 | GTAVKGKEAVHSDLG | SEQ 641 | GKEAV | SEQ 698 | 0 | 0 | 0 | 0 | 0 | 0 | 44 |
| ZIKV | 5 | −1.23 | 209 | WIESEKNDTWRLKRA | SEQ 642 | KNDTW | SEQ 699 | 0 | 0 | 0 | 0 | 0 | 0 | 47 |
| ZIKV | 6 | −1.36 | 259 | LSHHNTREGYRTQMK | SEQ 643 | TREGY | SEQ 700 | 0 | 0 | 0 | 0 | 0 | 0 | 45 |
| ZIKV | 7 | −0.86 | 291 | TKVHVEETCGTRGPS | SEQ 644 | EETCG | SEQ 701 | 0 | 0 | 0 | 0 | 0 | 0 | 47 |
| ZIKV | 8 | −1.56 | 303 | GPSLRSTTASGRVIE | SEQ 645 | STTAS | SEQ 702 | 0 | 0 | 0 | 0 | 0 | 0 | 46 |
| ZIKV | 9 | −1.85 | 341 | MEIRPRKEPESNLVR | SEQ 646 | RKEPE | SEQ 703 | 0 | 0 | 0 | 0 | 0 | 0 | 46 |

TABLE 18

Specificity of selected envelope peptides between flaviviruses and other microorganisms

| Column | BEPI | pos | Flanks | SEQ ID NO.: | BEPIpent | SEQ ID NO.: | SLE | HepC | JAEV | Parvo19 | Entero | RossRiver | EEE | *Plasmodium falciparum* |
|---|---|---|---|---|---|---|---|---|---|---|---|---|---|---|
| Isolates | | | | | | | 3 | 539 | 11 | | 90 | 12 | 4 | 1 |
| proteins | | | | | | | 24 | 539 | 11 | 225 | 990 | 109 | 44 | 5392 |
| DEN1 | −1.04 | 51 | ELLKTEVTNPAVLRK | 446 | EVTNP | 519 | 0 | 0 | 0 | 0 | 0 | 0 | 0 | 0 |
| DEN1 | −1.84 | 168 | IATITPQAPTSEIQL | 447 | PQAPT | 520 | 0 | 0 | 0 | 0 | 0 | 0 | 0 | 0 |
| DEN1 | −2.09 | 227 | WTSGASTSQETWNRQ | 448 | STSQE | 521 | 0 | 0 | 0 | 0 | 0 | 0 | 0 | 1 |
| DEN1 | −1.57 | 272 | TGATEIQTSGTTTIF | 449 | IQTSG | 522 | 0 | 0 | 0 | 0 | 0 | 0 | 0 | 0 |
| DEN1 | −1.55 | 329 | VQVKYEGTDAPCKIP | 450 | EGTDA | 523 | 0 | 0 | 0 | 0 | 0 | 0 | 0 | 0 |
| DEN1 | −1.77 | 344 | FLTQDEKGVTQNGRL | 451 | EKGVT | 524 | 0 | 0 | 0 | 0 | 0 | 0 | 0 | 5 |
| DEN1 | −0.99 | 361 | ANPIVTDKEKPVNIE | 452 | TDKEK | 525 | 0 | 0 | 0 | 0 | 0 | 0 | 0 | 10 |
| DEN1 | −1.55 | 371 | PVNIETEPPFGESYI | 453 | TEPPF | 526 | 0 | 0 | 0 | 0 | 0 | 0 | 0 | 0 |
| DEN2 | −1.65 | 226 | WLPGADTQGSNWIQK | 454 | DTQGS | 527 | 0 | 0 | 0 | 0 | 0 | 0 | 0 | 0 |
| DEN2 | −1.13 | 228 | PGADTQGSNWIQKET | 455 | QGSNW | 528 | 0 | 0 | 0 | 0 | 0 | 0 | 0 | 0 |
| DEN2 | −1.44 | 244 | VTFKNPHAKKQDVVV | 456 | PHAKK | 529 | 0 | 0 | 0 | 0 | 0 | 0 | 0 | 1 |
| DEN2 | −1.74 | 328 | IRVQYEGDGSPCKIP | 457 | EGDGS | 530 | 0 | 0 | 0 | 0 | 0 | 0 | 0 | 4 |
| DEN2 | −1.27 | 330 | VQYEGDGSPCKIPFE | 458 | DGSPC | 531 | 0 | 0 | 0 | 0 | 0 | 0 | 0 | 1 |
| DEN2 | −1.28 | 362 | PIVTEKDSPVNIEAE | 459 | KDSPV | 532 | 0 | 0 | 0 | 0 | 0 | 0 | 0 | 0 |
| DEN2 | −1.53 | 370 | PVNIEAEPPFGDSYI | 460 | AEPPF | 533 | 0 | 0 | 0 | 0 | 0 | 0 | 0 | 0 |
| DEN2 | −1.14 | 372 | NIEAEPPFGDSYIIN | 461 | PPFGD | 534 | 0 | 3 | 11 | 0 | 0 | 0 | 0 | 0 |
| DEN3 | −1.49 | 154 | QHQVGNETQGVTAEI | 462 | NETQG | 535 | 0 | 0 | 0 | 0 | 0 | 0 | 0 | 0 |
| DEN3 | −2.03 | 224 | WTSGATTETPTWNRK | 463 | TTETP | 536 | 0 | 0 | 0 | 0 | 0 | 0 | 0 | 2 |
| DEN3 | −1.63 | 269 | TGATEIQNSGGTSIF | 464 | IQNSG | 537 | 0 | 0 | 0 | 0 | 0 | 0 | 0 | 3 |
| DEN3 | −1.63 | 311 | VLKKEVSETQHGTIL | 465 | VSETQ | 538 | 0 | 0 | 0 | 0 | 0 | 0 | 0 | 4 |
| DEN3 | −1.24 | 327 | KVEYKGEDAPCKIPF | 466 | GEDAP | 539 | 0 | 0 | 0 | 0 | 0 | 0 | 0 | 0 |
| DEN3 | −1.02 | 327 | KVEYKGEDVPCKIPF | 467 | GEDVP | 540 | 0 | 0 | 0 | 0 | 0 | 0 | 0 | 0 |
| DEN3 | −1.31 | 336 | PCKIPFSTEDGQGKA | 468 | FSTED | 541 | 0 | 0 | 0 | 0 | 0 | 0 | 0 | 1 |
| DEN3 | −1.17 | 360 | PVVTKKEEPVNIEAE | 469 | KEEPV | 542 | 0 | 0 | 0 | 0 | 0 | 0 | 0 | 3 |
| DEN3 | −1.57 | 369 | VNIEAEPPFGESNIV | 470 | EPPFG | 543 | 24 | 3 | 11 | 0 | 0 | 0 | 0 | 0 |
| DEN4 | −1.18 | 48 | DFELTKTTAKEVALE | 471 | KTTAK | 544 | 0 | 0 | 0 | 0 | 0 | 0 | 0 | 1 |
| DEN4 | −1.68 | 155 | HAVGNDTSNHGVTAT | 472 | DTSNH | 545 | 0 | 0 | 0 | 0 | 0 | 0 | 0 | 2 |
| DEN4 | −1.59 | 166 | VTATTTPRSPSVEVE | 473 | TPRSP | 546 | 0 | 0 | 0 | 0 | 0 | 0 | 0 | 0 |
| DEN4 | −1.62 | 272 | GATEVDSGDGNHMFA | 474 | DSGDG | 547 | 0 | 0 | 0 | 0 | 0 | 0 | 0 | 3 |
| DEN4 | −1.29 | 315 | DKEMAETQHGTTVVK | 475 | ETQHG | 548 | 0 | 0 | 0 | 0 | 0 | 0 | 0 | 0 |
| DEN4 | −1.44 | 328 | VKVKYEGAGAPCKVP | 476 | EGAGA | 549 | 0 | 0 | 0 | 0 | 0 | 0 | 0 | 1 |
| DEN4 | −1.06 | 358 | ISSIPLAENTNSVTN | 477 | LAENT | 550 | 0 | 0 | 0 | 0 | 0 | 0 | 0 | 2 |
| DEN4 | −1.05 | 362 | PLAENTNSVTNIELE | 478 | TNSVT | 551 | 0 | 0 | 0 | 4 | 0 | 0 | 0 | 2 |
| PAN DEN | | 313 | | | ETQHG | 552 | 0 | 0 | 0 | 0 | 0 | 0 | 0 | 0 |
| PAN DEN | | 369 | | | EPPFG | 553 | 24 | 3 | 11 | 0 | 0 | 0 | 0 | 0 |
| PAN DEN | | 99 | | | DRGWG | 554 | 24 | 3 | 11 | 0 | 0 | 0 | 0 | 0 |

TABLE 18-continued

Specificity of selected envelope peptides between flaviviruses and other microorganisms

| Column | BEPI | pos | Flanks | SEQ ID NO.: | BEPIpent | SEQ ID NO.: | SLE | HepC | JAEV | Parvo19 | Entero | RossRiver | EEE | *Plasmodium falciparum* |
|---|---|---|---|---|---|---|---|---|---|---|---|---|---|---|
| PAN DEN | | 185 | | | SPRTG | 555 | 0 | 0 | 0 | 0 | 0 | 0 | 0 | 0 |
| PAN DEN | | 404 | | | TARGA | 556 | 0 | 1 | 0 | 0 | 0 | 0 | 0 | 0 |
| PAN DEN | | 394 | | | GSSIG | 557 | 24 | 3 | 0 | 0 | 0 | 0 | 0 | 1 |
| PAN DEN | | 74 | | | RCPTQ | 558 | 0 | 0 | 0 | 0 | 0 | 0 | 0 | 0 |
| PAN DEN | | 370 | | | PPFGD | 559 | 24 | 3 | 11 | 0 | 0 | 0 | 0 | 0 |
| YF | -1.04 | 52 | ETVAIDRPAEVRKVC | 479 | DRPAE | 560 | 0 | 0 | 0 | 0 | 0 | 0 | 0 | 0 |
| YF | -1.25 | 150 | HVGAKQENWNTDIKT | 480 | QENWN | 561 | 0 | 0 | 0 | 0 | 0 | 0 | 0 | 0 |
| YF | -1.22 | 165 | LKFDALSGSQEVEFI | 481 | LSGSQ | 562 | 0 | 0 | 0 | 0 | 0 | 0 | 0 | 2 |
| YF | -1.08 | 218 | DLTLPWQSGSGGVWR | 482 | WQSGS | 563 | 0 | 0 | 0 | 0 | 68 | 0 | 0 | 0 |
| YF | -1.50 | 250 | VLALGNQEGSLKTAL | 483 | NQEGS | 564 | 0 | 0 | 0 | 0 | 0 | 0 | 0 | 1 |
| YF | -1.73 | 267 | AMRVTKDTNDNNLYK | 484 | KDTND | 565 | 0 | 0 | 0 | 0 | 0 | 0 | 0 | 11 |
| YF | -2.21 | 311 | FFVKNPTDTGHGTVV | 485 | PTDTG | 566 | 12 | 1 | 0 | 0 | 0 | 0 | 0 | 0 |
| YF | -1.30 | 358 | VNPIASTNDDEVLIE | 486 | STNDD | 567 | 0 | 0 | 0 | 0 | 0 | 0 | 0 | 6 |
| YF | -1.61 | 356 | VTVNPIASTNDDEVL | 487 | IASTN | 568 | 0 | 0 | 2 | 0 | 12 | 0 | 0 | 3 |
| YF | -1.03 | 369 | VLIEVNPPFGDSYII | 488 | NPPFG | 569 | 0 | 0 | 0 | 0 | 0 | 0 | 0 | 0 |
| WNV | -1.52 | 38 | TIMSKDKPTIDVKMM | 489 | DKPTI | 1247 | 0 | 0 | 0 | 0 | 0 | 0 | 0 | 0 |
| WNV | -1.11 | 148 | FVHGPTTVESHGKIG | 490 | TTVES | 1248 | 0 | 0 | 0 | 0 | 0 | 0 | 0 | 0 |
| WNV | -1.21 | 188 | VTVDCEPRSGIDTSA | 491 | EPRSG | 1249 | 0 | 0 | 11 | 0 | 0 | 0 | 0 | 0 |
| WNV | -1.07 | 253 | SVVALGSQEGALHQA | 492 | GSQEG | 1250 | 24 | 3 | 0 | 0 | 0 | 0 | 0 | 0 |
| WNV | -0.81 | 295 | EKLQLKGTTYGVCSK | 493 | KGTTY | 1251 | 24 | 3 | 11 | 0 | 0 | 0 | 0 | 0 |
| WNV | -1.86 | 312 | KFARTPADTGHGTVV | 494 | PADTG | 1252 | 12 | 2 | 11 | 0 | 0 | 0 | 0 | 0 |
| WNV | -1.50 | 327 | LELQYTGTDGPCKVP | 495 | TGTDG | 1253 | 0 | 0 | 2 | 0 | 0 | 0 | 0 | 0 |
| WNV | -0.90 | 385 | YIVVGRGEQQINHHW | 496 | RGEQQ | 1254 | 0 | 0 | 0 | 0 | 0 | 0 | 0 | 0 |
| ZIKV | -0.62 | 16 | DFVEGMSGGTWVDIV | 497 | MSGGT | 1255 | 0 | 0 | 0 | 0 | 0 | 0 | 0 | 1 |
| ZIKV | -1.21 | 38 | TVMAQDKPTVDIELV | 498 | DKPTV | 1256 | 0 | 0 | 0 | 0 | 0 | 0 | 0 | 0 |
| ZIKV | -1.41 | 86 | AYLDKQSDTQYVCKR | 499 | QSDTQ | 570 | 0 | 0 | 0 | 0 | 0 | 0 | 0 | 0 |
| ZIKV | -1.37 | 128 | SKKMTGKSIQPENLE | 500 | GKSIQ | 571 | 0 | 0 | 0 | 0 | 0 | 0 | 0 | 5 |
| ZIKV | -0.84 | 145 | IMLSVHGSQHSGMIV | 501 | HGSQH | 572 | 0 | 0 | 0 | 0 | 0 | 0 | 0 | 0 |
| ZIKV | -2.20 | 159 | VNDTGHETDENRAKV | 502 | HETDE | 573 | 0 | 0 | 0 | 0 | 0 | 0 | 0 | 3 |
| ZIKV | -2.01 | 172 | KVEITPNSPRAEATL | 503 | PNSPR | 574 | 0 | 0 | 0 | 0 | 0 | 0 | 0 | 0 |
| ZIKV | -1.70 | 175 | ITPNSPRAEATLGGF | 504 | PRAEA | 575 | 0 | 0 | 0 | 0 | 0 | 0 | 0 | 0 |
| ZIKV | -1.55 | 233 | AGADTGTPHWNNKEA | 505 | GTPHW | 576 | 0 | 0 | 0 | 0 | 0 | 0 | 0 | 0 |
| ZIKV | -1.47 | 282 | EMDGAKGRLSSGHLK | 506 | KGRLS | 577 | 0 | 0 | 0 | 0 | 0 | 0 | 0 | 5 |
| ZIKV | -1.56 | 335 | EVQYAGTDGPCKVPA | 507 | GTDGP | 578 | 0 | 0 | 2 | 0 | 0 | 0 | 0 | 0 |
| ZIKV | -1.14 | 365 | ITANPVITESTENSK | 508 | VITES | 579 | 0 | 0 | 0 | 0 | 0 | 0 | 0 | 3 |
| ZIKV | -1.51 | 368 | NPVITESTENSKMML | 509 | ESTEN | 580 | 0 | 0 | 0 | 0 | 0 | 0 | 0 | 4 |
| ZIKV | -1.05 | 370 | VITESTENSKMMLEL | 510 | TENSK | 581 | 0 | 0 | 0 | 0 | 0 | 0 | 0 | 4 |
| | | | | | | | | | | | | | | 0 |
| CHIK | -1.14 | 40 | ALERIRNEATDGTLK | 511 | RNEAT | 583 | 0 | 0 | 0 | 0 | 0 | 0 | 0 | 1 |
| CHIK | -1.21 | 144 | GREKFHSRPQHGKEL | 512 | HSRPQ | 584 | 0 | 0 | 0 | 0 | 0 | 0 | 0 | 0 |
| CHIK | -1.18 | 249 | VPRNAELGDRKGKIH | 513 | EFGDR | 585 | 0 | 0 | 0 | 0 | 0 | 0 | 0 | 0 |
| CHIK | -1.46 | 274 | RVPKARNPTVTYGKN | 514 | RNPTV | 586 | 0 | 0 | 0 | 0 | 0 | 0 | 0 | 0 |
| CHIK | -1.14 | 276 | PKARNPTVTYGKNQV | 515 | PTVTY | 587 | 0 | 1 | 0 | 0 | 0 | 0 | 0 | 0 |
| CHIK | -1.27 | 303 | SYRNMGEEPNYQEEW | 516 | GEEPN | 588 | 0 | 0 | 0 | 0 | 0 | 0 | 0 | 0 |
| CHIK | -0.70 | 334 | EVTWGNNEPYKYWPQ | 517 | NNEPY | 589 | 0 | 0 | 0 | 0 | 0 | 0 | 0 | 3 |
| CHIK | -1.33 | 347 | PQLSTNGTAHGHPHE | 518 | NGTAH | 583 | 0 | 0 | 0 | 0 | 0 | 0 | 0 | 1 |

TABLE 19

Specificity of selected NS1 peptides between flaviviruses and other microorganisms

| Column | BEPI | pos | BepiPent | SEQ ID NO.: | Flanks | SEQ ID NO.: | SLE | HepC | JAEV | Parvo19 | Entero | RossRiver | EEE | *Plasmodium falciparum* |
|---|---|---|---|---|---|---|---|---|---|---|---|---|---|---|
| Isolates | | | | | | | 3 | 539 | 11 | | 90 | 12 | 4 | 1 |
| proteins | | | | | | | 24 | 539 | 11 | 225 | 990 | 109 | 44 | 5392 |
| DEN1 | -1.45 | 38 | DSPKR | 647 | YKFQADSPKRLSAAI | 590 | 0 | 0 | 0 | 0 | 0 | 0 | 0 | 0 |
| DEN1 | -0.75 | 104 | MIRPQ | 648 | AQGKKMIRPQPMEHK | 591 | 0 | 0 | 0 | 0 | 0 | 0 | 0 | 0 |
| DEN1 | -1.84 | 141 | TPECP | 649 | IDGPDTPECPDGQRA | 592 | 0 | 0 | 0 | 0 | 0 | 0 | 0 | 0 |
| DEN1 | -1.27 | 144 | CPDGQ | 650 | PDTPECPDGQRAWNI | 593 | 0 | 0 | 0 | 0 | 0 | 0 | 0 | 0 |
| DEN1 | -0.94 | 190 | KDSKA | 651 | MSAAIKDSKAVHADM | 594 | 0 | 0 | 0 | 0 | 0 | 0 | 0 | 1 |
| DEN1 | -1.17 | 206 | EKNET | 652 | YWIESEKNETWKLAR | 595 | 0 | 0 | 0 | 0 | 0 | 0 | 0 | 29 |
| DEN1 | -1.46 | 294 | NRGPS | 653 | DEHCGNRGPSLRTTT | 596 | 0 | 0 | 0 | 0 | 0 | 0 | 0 | 0 |
| DEN1 | -0.81 | 301 | TTTVT | 654 | GPSLRTTTVTGKIIH | 597 | 0 | 4 | 0 | 0 | 0 | 0 | 0 | 3 |
| DEN2 | -1.50 | 39 | SPSKL | 655 | KFQPESPSKLASAIQ | 598 | 0 | 0 | 0 | 0 | 0 | 0 | 0 | 5 |
| DEN2 | -2.00 | 105 | LRPQP | 656 | AGKRSLRPQPTELKY | 599 | 0 | 0 | 0 | 0 | 0 | 0 | 0 | 0 |
| DEN2 | -1.15 | 126 | STESH | 657 | KAKMLSTESHNQTFL | 600 | 0 | 0 | 0 | 0 | 0 | 0 | 0 | 1 |
| DEN2 | -1.43 | 142 | AECPN | 658 | DGPETAECPNTNRAW | 601 | 0 | 0 | 0 | 0 | 0 | 0 | 0 | 0 |
| DEN2 | -0.83 | 191 | DNRAV | 659 | SAAIKDNRAVHADMG | 602 | 0 | 0 | 0 | 0 | 0 | 0 | 0 | 1 |
| DEN2 | -1.03 | 248 | FAGPV | 660 | IIPKNFAGPVSQHNY | 603 | 0 | 0 | 0 | 0 | 0 | 0 | 0 | 0 |
| DEN2 | -1.02 | 262 | HTQTA | 661 | YRPGYHTQTAGPWHL | 604 | 0 | 0 | 0 | 0 | 0 | 0 | 0 | 0 |
| DEN2 | -1.37 | 291 | DCGNR | 662 | VVVTEDCGNRGPSLR | 605 | 0 | 0 | 0 | 0 | 0 | 0 | 0 | 0 |
| DEN3 | -1.40 | 37 | ADSPK | 663 | QYKFQADSPKRLATA | 606 | 0 | 0 | 0 | 0 | 0 | 0 | 0 | 0 |
| DEN3 | -1.33 | 103 | RTLTP | 664 | LKQGKRTLTPQPMEL | 607 | 0 | 0 | 0 | 0 | 0 | 0 | 0 | 1 |
| DEN3 | -1.80 | 140 | NTPEC | 665 | IIDGPNTPECPSASR | 608 | 0 | 0 | 0 | 0 | 0 | 0 | 0 | 0 |
| DEN3 | -0.90 | 190 | KDERA | 666 | MSAAVKDERAVHADM | 609 | 0 | 0 | 0 | 0 | 0 | 0 | 0 | 1 |
| DEN3 | -1.32 | 207 | KNGSW | 667 | WIESQKNGSWKLEKA | 610 | 0 | 0 | 0 | 0 | 0 | 0 | 0 | 0 |
| DEN3 | -1.11 | 257 | HRPGY | 668 | ISQHNHRPGYHTQTA | 611 | 0 | 0 | 0 | 0 | 0 | 0 | 0 | 0 |
| DEN3 | -0.86 | 290 | ENCGT | 669 | TVVITENCGTRGPSL | 612 | 0 | 0 | 0 | 0 | 0 | 0 | 0 | 0 |
| DEN3 | -0.86 | 301 | TTTVS | 670 | GPSLRTTTVSGKLIH | 613 | 0 | 3 | 0 | 0 | 0 | 0 | 0 | 2 |
| DEN4 | -1.18 | 39 | SPAHL | 671 | KFQPESPARLASAIL | 614 | 0 | 0 | 0 | 0 | 0 | 0 | 0 | 0 |
| DEN4 | -1.63 | 104 | ALTPP | 672 | TKGKRALTPPVSDLK | 615 | 0 | 15 | 0 | 0 | 1 | 0 | 0 | 1 |
| DEN4 | -1.07 | 125 | FTPEA | 673 | GKAKIFTPEARNSTF | 616 | 0 | 0 | 0 | 0 | 0 | 0 | 0 | 0 |
| DEN4 | -1.81 | 140 | DTSEC | 674 | LIDGPDTSECPNERR | 617 | 0 | 0 | 0 | 0 | 0 | 0 | 0 | 0 |
| DEN4 | -1.25 | 207 | KNQTW | 675 | WIESSKNQTWQIEKA | 618 | 0 | 0 | 0 | 0 | 0 | 0 | 0 | 0 |
| DEN4 | -1.20 | 248 | YAGPF | 676 | LIPKSYAGPFSQHNY | 619 | 0 | 0 | 0 | 0 | 0 | 0 | 0 | 0 |
| DEN4 | -1.01 | 260 | GYATQ | 677 | HNYRQGYATQTVGPW | 620 | 0 | 0 | 0 | 0 | 0 | 0 | 0 | 0 |
| DEN4 | -1.19 | 292 | CDHRG | 678 | TIQEDCDHRGPSLRT | 621 | 0 | 0 | 0 | 0 | 0 | 0 | 0 | 0 |
| WNV | -1.69 | 38 | PETPQ | 679 | RYKYYPETPQGLAKI | 622 | 0 | 0 | 0 | 0 | 0 | 0 | 0 | 1 |
| WNV | -1.16 | 102 | APKRL | 680 | GMYKSAPKRLTATTE | 623 | 2 | 0 | 9 | 0 | 0 | 0 | 0 | 1 |
| WNV | -1.43 | 144 | ECPTQ | 681 | GPETKECPTQNRAWN | 624 | 0 | 0 | 0 | 0 | 0 | 0 | 0 | 0 |

TABLE 19-continued

Specificity of selected NS1 peptides between flaviviruses and other microorganisms

| Column | BEPI | pos | BepiPent | SEQ ID NO.: | Flanks | SEQ ID NO.: | SLE | HepC | JAEV | Parvo19 | Entero | RossRiver | EEE | *Plasmodium falciparum* |
|---|---|---|---|---|---|---|---|---|---|---|---|---|---|---|
| WNV | -1.74 | 177 | NTTEC | 682 | KVRESNTTECDSKII | 625 | 10 | 3 | 0 | 0 | 0 | 0 | 0 | 1 |
| WNV | -1.47 | 261 | GYKTQ | 683 | HNRRPGYKTQNQGPW | 626 | 0 | 0 | 11 | 0 | 0 | 0 | 0 | 0 |
| WNV | -1.90 | 266 | NQGPW | 684 | GYKTQNQGPWDEGRV | 627 | 0 | 0 | 11 | 0 | 0 | 0 | 0 | 0 |
| WNV | -1.67 | 297 | GPATR | 685 | SCGHRGPATRTTTES | 628 | 0 | 0 | 0 | 0 | 0 | 0 | 0 | 0 |
| WNV | -1.54 | 303 | TTESG | 686 | PATRTTTESGKLITD | 629 | 0 | 0 | 0 | 0 | 0 | 0 | 0 | 1 |
| YF | -1.21 | 35 | YYPED | 687 | LNKYSYYPEDPVKLA | 630 | 0 | 0 | 0 | 0 | 0 | 0 | 0 | 0 |
| YF | -1.41 | 140 | SRKEC | 688 | IIDGKSRKECPFSNR | 631 | 0 | 0 | 0 | 0 | 0 | 0 | 0 | 2 |
| YF | -2.21 | 193 | KSAHG | 689 | AVNGKKSAHGSPTFW | 632 | 0 | 0 | 0 | 0 | 0 | 0 | 0 | 2 |
| YF | -1.12 | 234 | GTSVE | 690 | LTHTIGTSVEESEMF | 633 | 0 | 0 | 0 | 0 | 0 | 0 | 0 | 2 |
| YF | -1.05 | 264 | QTNGP | 691 | PGYKVQTNGPWMQVP | 634 | 0 | 0 | 0 | 0 | 0 | 0 | 0 | 2 |
| YF | -2.05 | 295 | RGKST | 692 | GNCDGRGKSTRSTTD | 635 | 0 | 0 | 0 | 0 | 0 | 0 | 0 | 2 |
| YF | -2.15 | 301 | STTDS | 693 | GKSTRSTTDSGKVIP | 636 | 0 | 0 | 0 | 0 | 0 | 0 | 0 | 5 |
| YF | -1.15 | 338 | PRKTH | 694 | PMEIRPRKTHESHLV | 637 | 0 | 0 | 0 | 0 | 0 | 0 | 0 | 1 |
| ZIKV | -1.55 | 14 | KETRC | 695 | VDFSKKETRCGTGVF | 638 | 0 | 0 | 0 | 0 | 0 | 0 | 0 | 0 |
| ZIKV | -1.62 | 38 | HPDSP | 696 | DRYKYHPDSPRRLAA | 639 | 0 | 0 | 0 | 0 | 0 | 0 | 0 | 0 |
| ZIKV | -1.06 | 130 | AKTNN | 697 | HFVRAAKTNNSFVVD | 640 | 0 | 0 | 0 | 0 | 0 | 0 | 0 | 0 |
| ZIKV | -1.23 | 193 | GKEAV | 698 | GTAVKGKEAVHSDLG | 641 | 0 | 0 | 0 | 0 | 0 | 0 | 0 | 1 |
| ZIKV | -1.23 | 209 | KNDTW | 699 | WIESEKNDTWRLKRA | 642 | 0 | 0 | 0 | 0 | 0 | 0 | 0 | 1 |
| ZIKV | -1.36 | 259 | TREGY | 700 | LSHHNTREGYRTQMK | 643 | 0 | 0 | 0 | 0 | 0 | 0 | 0 | 0 |
| ZIKV | -0.86 | 291 | EETCG | 701 | TKVHVEETCGTRGPS | 644 | 0 | 0 | 0 | 0 | 0 | 0 | 0 | 1 |
| ZIKV | -1.56 | 303 | STTAS | 702 | GPSLRSTTASGRVIE | 645 | 0 | 1 | 0 | 0 | 0 | 0 | 0 | 0 |
| ZIKV | -1.85 | 341 | RKEPE | 703 | MEIRPRKEPESNLVR | 646 | 0 | 0 | 0 | 0 | 0 | 0 | 0 | 0 |

The diagnostic sets of B cell epitope peptides may be deployed, preferably but not necessarily as a 15mer, singly as arrays or as a pool of peptides to identify antibodies arising from infection by Zika or the other viruses represented. Many possible delivery formats are possible to attach peptides to a substrate including, but not limited to, directly, via biotin, via a histag, via am immunoglobulin Fc or other fusion partner. Said substrate and antigens can then be used in several different diagnostic immunoassay formats, including but not limited to ELISA, or on microbeads, or in solution. The presence of antibody specifically binding to the diagnostic peptide may be detected by a secondary antibody. A secondary antibody may be selected to detect bound IgG or IgM from human or from other potentially infected species of interest which may be infected and which may serve as reservoir species.

In an alternative approach to a diagnostic kit synthetic proteins from Zika envelope are prepared in which epitopes that are cross reactive with other flaviviruses are removed. Exemplars of these are shown in SEQS 393, 395 and 397. Said synthetic polypeptides may be the full soluble Zika envelope sequence. In preferred embodiments, however, polypeptides comprising only Domain I or Domain II or Domain III of the Zika envelope protein are synthesized. Said polypeptides may be fused to an immunoglobulin Fc molecule. In some instances, they are expressed as a Fc fusion in a host cell and subsequently cleaved to facilitate inclusion in the diagnostic kit.

Example 11: Diagnostic Peptide Cross Reactions

By applying immunoinformatic methods previously described (PCT US2011/029192, PCT US2012/055038, and US2014/014523, U.S. Patent Application No. 62/306,262, each of which is incorporated herein by reference) we identified high probability B cell epitopes in Zika virus proteins and in the corresponding proteins of dengue serotypes, yellow fever and WNV. This resulted in a set of 8-14 peptides of interest selected for further examination for each virus. We then searched the proteins of various other pathogens likely to be co-endemic with these flaviviruses to determine if the corresponding pentamers were present. In the case of *Plasmodium* we searched the entire proteome of *P. falciparum* strain 3D7. The patterns of pentamer identity are shown in Tables 18 and 19. While a few peptides are in common with other flaviviruses, a far greater occurrence of cross reactions occurs with *Plasmodium* and the selected peptides in flaviruses of interest. Also noted is that *Plasmodium* does not have the peptides identified as "pan-flavi" or common to all the flaviviruses of interest. While this scan was performed only based on the selected set of 8-14 peptides it provided an indicator of probable cross reactivity and also of the absence of the pan flavi peptides in malaria. Thus diagnostics which depend on pan-flavi epitopes will fail to differentiate between the flaviviruses but will not result in false positives due to prior malaria infections. FIG. 24 provides further evidence of the absence of B cell epitopes in malaria which correspond to the fusion loop region of dengue and Zika.

Example 12. Mapping of Epitopes in Envelope and NS1 Proteins and Malaria Proteomes We conducted a complete epitope mapping of the proteome of *P. falciparum* strain 3D7 and *P. vivax* Sal1, each comprising in excess of 5000 proteins. Parameters mapped included B cell epitopes, MHC binding, cathepsin cleavage, T cell exposed motif usage and topology. A comparison of B cell epitope probability to every B cell epitope probability in the envelope and NS1 proteins of Zika, Den1 Den2 Den3 Den 4, YF and WNV was done. FIGS. 25-28 show the location of B cell epitope pentamer matches for Envelope and NS1 for Zika and for representative dengue exemplars. Similar data and graphics were generated for the other flaviviruses of interest

Example 13: Tabulating B Cell Epitope Matches

We selected Zika peptides which have a B cell probability more than one standard deviation greater than the mean, comprising the top 15.86% in the protein. We then identified those which corresponded to peptides with the same probability of being a B cell epitope in a protein of *P. falciparum* or *P. vivax*. Table 20 shows the results for Zika Envelope and Table 21 shows the results for Zika NS1. As the Asian American Zika virus has exhibited a high level of conservation these tables identify malaria protein epitopes which can provide cross protective antibodies. Selection of vaccine components should then take into consideration the life stage in which the malaria proteins identified are expressed, their surface exposure and transcription level to arrive at a final vaccine design.

Tables 22 and 23 provide corresponding in formation for other flaviviruses of interest based on a representative South American strain. Because minor strain variations may occur between isolates of each of these viruses the tables are considered indicative of the process of selecting matching *Plasmodium* epitopes but geographical differences may need to be factored into vaccine design.

It should be noted that in all following tables probability of B cell epitope binding is indicated as an inverted value; the most negative numbers indicate highest probability of binding.

TABLE 20

| | BEPI pentamer | BEPI (virus) | P_faclciparum BEPI (standard uTOPE) | gi: curation - *P. falciparum* | P_vivax BEPI (standard uTOPE) |
|---|---|---|---|---|---|
| SEQ 705 | ASDSR | -1.01 | | | -1.57 |
| SEQ 706 | SRCPT | -1.80 | | | -1.03 |
| SEQ 707 | CPTQG | -1.64 | | | -1.05 |
| SEQ 708 | PTQGE | -1.38 | | | -2.04 |
| SEQ 709 | TQGEA | -1.04 | -1.74 | PF3D7_1240400_erythrocyte membrane protein 1 | -1.33 |

TABLE 20-continued

| | | | | | |
|---|---|---|---|---|---|
| SEQ 710 | DKQSD | -1.21 | -1.33 | PF3D7_0930400.2_conserved *Plasmodium* protein | -1.29 |
| SEQ 711 | QSDTQ | -1.41 | | | -1.68 |
| SEQ 712 | KMTGK | -1.12 | -1.49 | PF3D7_1408700_conserved *Plasmodium* protein | 0.03 |
| SEQ 713 | NDTGH | -1.04 | | | -1.19 |
| SEQ 714 | ETDEN | -2.06 | -1.07 | PF3D7_1115400_cysteine proteinase falcipain 3 (FP3 | -0.65 |
| SEQ 715 | TDENR | -1.77 | -1.07 | PF3D7_1425600_zinc finger protein | -1.69 |
| SEQ 716 | NSPRA | -1.98 | | | -1.05 |
| SEQ 717 | SPRAE | -1.89 | | | -1.58 |
| SEQ 718 | RAEAT | -1.31 | -0.91 | PF3D7_1430700_NADP-specific glutamate dehydrogenase (GDH2) | -1.15 |
| SEQ 719 | AGADT | -1.18 | | | -1.42 |
| SEQ 720 | GADTG | -1.52 | -0.38 | PF3D7_0931700_PIH1 domain-containing protein | -1.04 |
| SEQ 723 | ADTGT | -1.76 | -1.67 | PF3D7_1255200_erythrocyte membrane protein 1 | -1.06 |
| SEQ 724 | DIGTP | -1.90 | | | -1.30 |
| SEQ 725 | GAKGR | -1.32 | | PF3D7_1125500_small nuclear ribonucleoprotein Sm D1 | -1.71 |
| SEQ 726 | KGRES | -1.47 | -1.20 | PF3D7_0818900_heat shock protein 70 (HSP70) | -0.56 |
| SEQ 727 | AGTDG | -1.53 | -1.69 | PF3D7_1035200_S-antigen | -2.06 |
| SEQ 728 | GTDGP | -1.56 | | | -1.80 |
| SEQ 729 | TDGPC | -1.45 | -1.45 | PF3D7_1300300_erythrocyte membrane protein 1 | |
| SEQ 730 | DGPCK | -1.19 | -1.16 | PF3D7_0712900_erythrocyte membrane protein 1 | |
| SEQ 731 | ITEST | -1.43 | -0.25 | PF3D7_0104000_thrombospondin-related sporozoite protein (TRSP) | -1.05 |
| SEQ 732 | TESTE | -1.62 | -1.93 | PF3D7_1122600_conserved *Plasmodium* protein | -0.51 |
| SEQ 733 | ESTEN | -1.51 | -0.98 | PF3D7_0205300_conserved *Plasmodium* protein | -1.23 |
| SEQ 734 | STENS | -1.30 | -1.03 | PF3D7_1418100_liver specific protein 1 | -1.63 |
| SEQ 735 | TENSK | -1.05 | -1.27 | PF3D7_1418100_liver specific protein 1 | |
| SEQ 736 | GSTIG | -1.10 | -0.40 | PF3D7_1205500_zinc finger protein | -1.04 |
| SEQ 737 | NTKNG | -1.29 | -1.57 | PF3D7_0904900_copper-transporting ATPase (CuTP) | -1.11 |
| SEQ 738 | TKNGS | -1.42 | -0.88 | PE3D7_1000100_erythrocyte membrane protein 1 | -1.87 |

TABLE 20-continued

| | gi: curation (P_vivax) | pos | Virus |
|---|---|---|---|
| SEQ 705 | PVX_085120_protein kinase | 70 | Zika |
| SEQ 706 | PVX_093705_variable surface protein Vir18 | 73 | Zika |
| SEQ 707 | PVX_095125_hypothetical protein | 75 | Zika |
| SEQ 708 | PVX_084330_hypothetical protein | 76 | Zika |
| SEQ 709 | PVX_018660_unspecified | 77 | Zika |
| SEQ 710 | PVX087865_hypothetical protein | 84 | Zika |
| SEQ 711 | PVX_122920_hypothetical protein | 86 | Zika |
| SEQ 712 | PVX_122905_hypothetical protein | 125 | Zika |
| SEQ 713 | PVX_054190_unspecified | 155 | Zika |
| SEQ 714 | PVX_10072_hypothetical protein | 160 | Zika |
| SEQ 715 | PVX_085020_autophagy protein 5 | 161 | Zika |
| SEQ 716 | PVX_116560_RNA-binding protein | 173 | Zika |
| SEQ 717 | PVX116690_hypothetical protein | 174 | Zika |
| SEQ 718 | PVX_111070_S-adenosylmethionine decarboxylase-ornithine decarboxylase | 176 | Zika |
| SEQ 719 | PVX_089985_hypothetical protein | 228 | Zika |
| SEQ 720 | PVX_118475_stromal-processing peptidase | 229 | Zika |
| SEQ 723 | PVX_113550_hypothetical protein | 230 | Zika |
| SEQ 724 | PVX_113550_hypothetical protein | 231 | Zika |
| SEQ 725 | PVX_081345_secreted ookinete protein | 280 | Zika |
| SEQ 726 | PVX_003880_acyl_carrier protein | 282 | Zika |
| SEQ 727 | PVX_117880_rhoptry neck protein 2 | 334 | Zika |
| SEQ 728 | PVX_001810_hypothetical protein | 335 | Zika |
| SEQ 729 | | 336 | Zika |
| SEQ 730 | | 337 | Zika |
| SEQ 731 | PVX_122795_hypothetical protein | 366 | Zika |
| SEQ 732 | PVX_101210_hypothetical protein | 367 | Zika |
| SEQ 733 | PVX_115350_hypothetical protein | 368 | Zika |
| SEQ 734 | PVX_122470_eukaryotic translation initation factor 4 gamma | 369 | Zika |
| SEQ 735 | | 370 | Zika |
| SEQ 736 | PVX_082915_ABC transporter B family member 5 | 405 | Zika |
| SEQ 737 | PVX_082580_20 kDa chaperonin | 479 | Zika |
| SEQ 738 | PVX_080580_hypothetical protein | 480 | Zika |

TABLE 21

| | BEPI penta | BEPI (virus) | P_faclciparum BEPI (standard uTOPE) | gi: curation | P_vivax BEPI (standard uTOPE) | gi: curation (P_vivax) | pos | Virus |
|---|---|---|---|---|---|---|---|---|
| SEQ 739 | SKKET | -1.13 | -1.61 | PF3D7_1401200_Plasmodium exported protein | -1.36 | PVX_084440_hypothetical protein | 12 | Zika |
| SEQ 740 | KKETR | -1.43 | -1.07 | PF3D7_1138400_guanylyl cyclase (GCalpha) | 0.23 | PVX_086240_serine_threonine protein phosphatase CPPED1 | 13 | Zika |
| SEQ 741 | YHPDS | -1.43 | -1.46 | PF3D7_0823800_DnaJ protein | -0.78 | PVX091085_hypothetical protein | 37 | Zika |
| SEQ 742 | HPDSP | -1.62 | | | -1.59 | PVX_091136_hypothetical protein | 38 | Zika |
| SEQ 743 | DSPRR | -1.26 | | | -1.37 | PVX_087955_O1 | 40 | Zika |
| SEQ 744 | AKTNN | -1.06 | | | -1.23 | PVX_100825_hypothelical protein | 130 | Zika |
| SEQ 745 | KTNNS | -1.09 | -2.07 | PF3D7_0202000_knob-associated histidine-rich protein (KAHRP) | -1.44 | PVX_000975_liver specific protein 2 | 131 | Zika |
| SEQ 746 | KGKEA | -1.13 | -1.62 | PF3D7_0221700_Plasmodium exported protein | -0.93 | PVX_094855_NLI interacting factor-like phosphatase | 192 | Zika |
| SEQ 747 | SEKND | -1.07 | -1.62 | PF3D7_0613900_myosin E | -1.47 | PVX_091434_rhoptry neck protein 4 (RON4) | 207 | Zika |
| SEQ 748 | EKNDT | -1.23 | -1.00 | PF3D7_1428400_WD and tetratricopeptide repeats protein 1 | -1.55 | PVX_115415_hypothetical protein | 208 | Zika |
| SEQ 749 | NTREG | -1.22 | -1.25 | PF3D7_1332000_syntaxin | -0.83 | PVX_082530_syntaxin 5 | 258 | Zika |
| SEQ 750 | GTRGP | -1.63 | | | -1.80 | PVX_092925_CCAAT-box DNA binding protein subunit B | 295 | Zika |
| SEQ 751 | TRGPS | -1.55 | | | -1.36 | PVX_132260_unspecified | 296 | Zika |
| SEQ 752 | LRSTT | -1.63 | | | -1.14 | PYX_120335_unspecified | 301 | Zika |
| SEQ 753 | STTAS | -1.56 | | | -1.71 | PVX_113460_DNA repair protein RAD50 | 303 | Zika |
| SEQ 754 | TTASG | -1.45 | -1.73 | PF3D7_0712900_erythrocyte membrane protein 1 | -1.87 | PVX_113460_DNA repair protein RAD50 | 304 | Zika |
| SEQ 755 | TASGR | -1.25 | | AP2 domain(s) | -1.00 | PVX_090110_transcription factor with | 305 | Zika |
| SEQ 756 | RPRKE | -1.59 | -1.10 | PF3D7_0935400_gametocyte development protein 1 (GDV1) | -1.53 | PVX_094890_hypothetical protein | 339 | Zika |

TABLE 21-continued

| | BEPI penta | BEPI (virus) | P_faclciparum BEPI (standard uTOPE) | gi: curation | P_vivax BEPI (standard uTOPE) | gi: curation (P_vivax) | pos | Virus |
|---|---|---|---|---|---|---|---|---|
| SEQ 757 | KEPES | -1.73 | -1.46 | PF3D7_1030100_pre-mRNA-splicing factor ATP-dependent RNA helicase PRP22 | -0.06 | PVX_099540_glutamine synthelase | 342 | Zika |
| SEQ 758 | EPESN | -1.52 | -1.10 | PF3D7_1001900_Plasmodium exported protein (hyp16) | -0.25 | PVX_123682_heterochromatin protein 1 | 343 | Zika |

TABLE 22

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| WNV | SEQ 759 | 37 | KDKPT | -1.38 | -0.41 | PF3D7_131080_conserved *Plasmodium* protein | -1.97 | PVX_081215_hypothetical protein |
| WNV | SEQ 760 | 83 | NEKRA | -1.55 | -0.17 | PF3D7_0526500_conserved *Plasmodium* protein | -1.29 | PVX_084330_hypothetical protein |
| WNV | SEQ 761 | 84 | EKRAD | -1.44 | -1.04 | PF3D7_0703900_conserved *Plasmodium* membrane protein | -0.72 | PVX_082850_hypothetical protein |
| WNV | SEQ 762 | 85 | KRADP | -1.25 | -0.86 | PF3D7_1039000_serine_threonine_protein kinase | -1.35 | PVX_085070_rRNA (adenosine-2'-O-)-methyltransferase |
| WNV | SEQ 763 | 148 | TTVES | -1.11 | | | -1.12 | PVX_241295_unspecified |
| WNV | SEQ 764 | 154 | GKIGA | -1.08 | -0.33 | PF3D7_0600100_erythrocyte membrane protein 1 (PfEMP1) | -1.04 | PVX_116760_hypothetical protein |
| WNV | SEQ 765 | 166 | ITPSA | -1.22 | -0.26 | PF3D7_1421200_40S ribosomal protein S25 (RPS25) | -1.21 | PVX_097815_trafficking protein particle complex subunit 8 |
| WNV | SEQ 766 | 167 | TPSAP | -148 | | | -1.93 | PVX_085020_autophagy protein 5 |
| WNV | SEQ 767 | 168 | PSAPS | -1.60 | -2.30 | PF3D7_0800300_erythrocyte membrane protein 1 | -2.12 | PVX_110965_hypothetical protein |
| WNV | SEQ 768 | 188 | EPRSG | -1.21 | | | -1.39 | PVX_116670_hypothetical protein |
| WNV | SEQ 769 | 223 | SSAGS | -1.23 | -0.90 | PF3D7_0401000_rifin (RIF) | -1.33 | PVX_118345_protein transport protein SEC7 |
| WNV | SEQ 770 | 224 | SAGST | -1.38 | | | -2.03 | PVX_080355_transcrition factor with AP2 domain(s) |
| WNV | SEQ 771 | 225 | AGSTT | -1.48 | -1.78 | PF3D7_0202000_knob-associated histidine-rich protein (KAHRP) | -1.11 | PVX_089055_E3 ubiquitin-protein ligase |
| WNV | SEQ 772 | 253 | GSQEG | -1.07 | | | -1.78 | PVX_080320_ATP-dependent RNA helicase DDX23 |
| WNV | SEQ 773 | 254 | SQEGA | -1.02 | -1.60 | PF3D7_0212300_peptide chain release factor subunit 1 | -1.90 | PVX_101355_protein phosphatase PPM4 |
| WNV | SEQ 774 | 309 | ARTPA | -1 22 | | | -1.04 | PVX_089895_glutamyl-tRNA(Gln) amidotransferase subunit A |
| WNV | SEQ 775 | 312 | PADTG | -1.86 | | | -1.90 | PVX_092395_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| WNV | SEQ 776 | 314 | DTGHG | -1.38 | | | -1.31 | PVX_054190_unspecified |
| WNV | SEQ 777 | 328 | GTDGP | -1.44 | | | -1.80 | PVX_001810_hypothetical protein |
| WNV | SEQ 778 | 329 | TDGPC | -1.18 | -1.45 | PF3D7_1300300_erythrocyte membrane protein 1 | | |
| WNV | SEQ 779 | 396 | KSGSS | -1.27 | -2.30 | PF3D7_1200600_erythrocyte membrane protein 1 | -1.72 | PVX_116765_vanant-silencing SET protein |
| WNV | SEQ 780 | 397 | SGSSI | -1.43 | -0.22 | PF3D7_1308900_mRNA-decapping enzyme 2 | -1.35 | PVX_013625_unspecified |
| WNV | SEQ 781 | 398 | GSSIG | -1.30 | -0.38 | PF3D7_1431600_ATP-specific succinyl-CoA synthetase beta subunit | -1.25 | PVX_123970_ataxin-3 |
| DEN3 | SEQ 782 | 37 | KNKPT | -1.20 | -1.63 | PF3D7_201900_erythrocyte membrane protein 3 (EMP3) | -1.31 | PVX_099980_merozoite surface protein 1 (MSP1) |
| DEN3 | SEQ 783 | 39 | KPTLD | -1.01 | -1.13 | PF3D7_1465100_conserved *Plasmodium* protein | -0.44 | PVX_081830_Plasmodium exported protein |
| DEN3 | SEQ 784 | 48 | KTEAT | -1.16 | -1.45 | PF3D7_1342600_myosin A (MyoA) | -1.69 | PVX_097680_merozoite surface protein 3 (MSP3_3) |
| DEN3 | SEQ 785 | 73 | SRCPT | -1.62 | | | -1.03 | PVX_093705_variable surface protein Vir18 |
| DEN3 | SEQ 786 | 75 | CPTQG | -1.52 | | | -1.05 | PVX_095125_hypothetical protein |
| DEN3 | SEQ 787 | 76 | PTQGE | -1.19 | | | -2.04 | PVX_084330_hypothetical protein |
| DEN3 | SEQ 788 | 84 | PEEQD | -1.23 | -1.40 | PF3D7_1207800_conserved *Plasmodium* protein | | |
| DEN3 | SEQ 789 | 85 | WWQDQ | -1.18 | -2.02 | PF3D7_1448500_conserved *Plasmodium* protein | -1.84 | PVX_088840_Phist protein Pf-fam-b) |
| DEN3 | SEQ 790 | 151 | QVGNE | -1.40 | -1.21 | PF3D7_1255200_erythrocyte membrane protein 1 | -0.91 | PVX_098950_hypothetical protein |
| DEN3 | SEQ 791 | 154 | NETQG | -1.49 | | | -1.56 | PVX_096115_protein kinase |
| DEN3 | SEQ 792 | 165 | PQAST | -1.71 | -2.09 | PF3D7_1115800_conserved *Plasmodium* protein | | |
| DEN3 | SEQ 793 | 166 | QASTT | -1.50 | -1.11 | PF3D7_1149000_antigen 332 | -0.78 | PVX_117920_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN3 | SEQ 794 | 167 | ASTTE | −1.26 | −1.85 | PF3D7_0202000_knob-associated histidine-rich protein (KAHRP) | | |
| DEN3 | SEQ 795 | 220 | TSGAT | −1.21 | −0.72 | PF3D7_0727200_cysteine desulfurase | −1.64 | PVX_099415_GNS1_SUR4 domain containing protein |
| DEN3 | SEQ 796 | 221 | SGATT | −1.46 | −2.07 | PF3D7_0712900_erythrocyte membrane protein 1 | −1.86 | PVX_085725_hypothetical protein |
| DEN3 | SEQ 797 | 222 | GATTE | −1.70 | | | −1.63 | PVX_117880_rhoptry neck protein 2 |
| DEN3 | SEQ 798 | 223 | ATTET | −1.90 | −1.69 | PF3D7_1100200_erythrocyte membrane protein 1 | −1.39 | PVX_002835_T-complex protein 1 subunit theta |
| DEN3 | SEQ 799 | 224 | TTETP | −2.03 | −1.27 | PF3D7_1200600_erythrocyte membrane protein | −2.00 | PVX_093680_Phist protein (Pf-fam-b) |
| DEN3 | SEQ 800 | 225 | TETPT | −1.93 | | | −1.22 | PVX_097800_hypothetical protein |
| DEN3 | SEQ 801 | 270 | QNSGG | −1.58 | | | −2.03 | PVX_091775_leucine-rich repeat protein (LRR11) |
| DEN3 | SEQ 802 | 271 | NSGGT | −1.44 | −1.60 | PF3D7_0833500_erythrocyte membrane protein 1 | −1.94 | PVX_091660_hypothetical protein |
| DEN3 | SEQ 803 | 272 | SGGTS | −1.20 | −2.26 | PF3D7_0712300_erythrocyte membrane protein 1 | −1.74 | PVX_089395_perforin-like protein 4 (PLP4) |
| DEN3 | SEQ 804 | 311 | VSETQ | −1.63 | −1.39 | PF3D7_1332200_conserved *Plasmodium* protein. | −0.31 | PVX_090860_CPW-WPC family protein |
| DEN3 | SEQ 805 | 312 | SETQH | −1.44 | | | −1.24 | PVX_114800_hypothetical protein |
| DEN3 | SEQ 806 | 325 | YKGED | −1.39 | −1.26 | PF3D7_0621400_Pf77 protein (ALV7) | −0.84 | PVX_094800_hypothetical protein |
| DEN3 | SEQ 807 | 326 | KGEDA | −1.42 | | | −1.38 | PVX_089010_translation initiation factor IF-2 |
| DEN3 | SEQ 808 | 327 | GEDAP | −1.24 | | | −1.33 | PVX_077695_unspecified |
| DEN3 | SEQ 809 | 337 | STEDG | −1.59 | | | −1.74 | PVX_092070_parasitophorous vacuolar protein 1 |
| DEN3 | SEQ 810 | 3.38 | TEDGQ | −1.80 | −1.82 | PF3D7_1403100_conserved *Plasmodium* protein | | |
| DEN3 | SEQ 811 | 339 | EDGQG | −1.86 | −2.17 | PF3D7_1206200_eukaryotic translation initiation factor 3 subunit C | −1.18 | PVX_089295_ATP-dependent RNA helicase prh1 |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN3 | SEQ 812 | 340 | DGQGK | −1.94 | −2.02 | PF3D7_1206200_eukaryotic translation initiation factor 3 subunit C | −1.07 | PVX_096180_hypothetical protein |
| DEN3 | SEQ 813 | 342 | QGKAH | −1.80 | | | −1.07 | PVX_092415_hypothetical protein |
| DEN3 | SEQ 814 | 358 | TKKEE | −1.13 | −1.82 | PF3D7_1206200_eukaryotic translation initiation factor 3 subunit C | −0.43 | PVX_092070_parasitophorous vacuolar protein 1 |
| DEN3 | SEQ 815 | 359 | KKEEP | −1.13 | −0.79 | PF3D7_1233600_asparagine and aspartate rich protein 1 (AARP1) | −1.74 | PVX_118345_protein transport protein SEC7 |
| DEN3 | SEQ 816 | 367 | EAEPP | −1.24 | | | −1.29 | PVX_122665_hypothetical protein |
| DEN3 | SEQ 817 | 369 | EPPFG | −1.57 | | | −1.11 | PVX_118340_serine_threonine protein kinase |
| DEN3 | SEQ 818 | 392 | KKGSS | −1.01 | −0.56 | PF3D7_1469600_biotin catboxylase subunit of acetyl CoA carboxylase | −1.74 | PVX_112720_unspecified |
| DEN3 | SEQ 819 | 394 | GSSIG | −1.03 | −0.38 | PF3D7_1431600_ATP-specific succinyl-CoA synthetase beta subunit | −1.25 | PVX_123970_ataxin-3 |
| DEN3 | SEQ 820 | 468 | NSKNT | −1.18 | −0.54 | PF3D7_1467200_WD repeat-containing protein 79 | −1.15 | PVX_114965_hypothetical protein |
| DEN3 | SEQ 821 | 469 | SKNTS | −1.31 | −1.59 | PF3D7_0504700_centrosomal protein CEP120 | | PVX_111430_cytochrome c oxidase copper chaperone |
| DEN3 | SEQ 822 | 470 | KNTSM | −1.25 | −1.13 | PF3D7_1035800_probable protein | −0.18 | PVX_100940_hypothetical protein |
| DEN4 | SEQ 823 | 37 | QGKPT | −1.16 | | | −1.35 | PVX_000975_liver specific protein 2 |
| DEN4 | SEQ 824 | 47 | TKTTA | −1.10 | −1.11 | PF3D7_1040600_rifin (RIF) protein kinase 6 | −1.64 | PVX_091755_calcium-dependent |
| DEN4 | SEQ 825 | 48 | KTTAK | −1.18 | −0.82 | PF3D7_1255200_erythrocyte membrane protein 1 | −1.67 | PVX_112685 unspecified |
| DEN4 | SEQ 826 | 49 | TTAKE | −1.07 | −0.22 | PF3D7_1150000_rifin (RIF) | −1.14 | PVX_122645_pre-mRNA-processing factor 40 |
| DEN4 | SEQ 827 | 75 | CPTQG | −1.55 | | | −1.05 | PVX_095125_hypothetical protein |
| DEN4 | SEQ 828 | 76 | PTQGE | −1.49 | | | −2.04 | PVX_084330_hypothetical protein |
| DEN4 | SEQ 829 | 77 | TQGEP | −1.28 | | | −1.17 | PVX_099635_conserved *Plasmodium* protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN4 | SEQ 830 | 83 | LKEEQ | −1.03 | −0.65 | PF3D7_0504700_centrosomal protein CEP120 | −1.06 | PVX_003885_ribosome-recycling factor |
| DEN4 | SEQ 831 | 84 | KEEQD | −1.08 | −0.63 | PF3D7_0618500_malate dehydrogenase (MDH) | −1.75 | PVX_079865_Hsc70-interacting protein |
| DEN4 | SEQ 832 | 85 | EEQDQ | −1.12 | −2.02 | PF3D7_1448500_conserved *Plasmodium* protein | −1.84 | PVX_088840_Phist protein (Pf-fam-b) |
| DEN4 | SEQ 833 | 147 | GDTHA | −1.06 | −0.87 | PF3D7_0930800_conserved *Plasmodium* membrane protein | −1.21 | PVX_087780_phosphopantetheine adenylyltransferase |
| DEN4 | SEQ 834 | 153 | GNDTS | −1.54 | −1.41 | PF3D7_0731500_erythrocyte binding antigen-175 (EBA175) | −1.67 | PVX_095475_circumsporozoite- and TRAP-related protein |
| DEN4 | SEQ 835 | 166 | TPRSP | −1.59 | | | −1.25 | PVX_113574_hypothetical protein |
| DEN4 | SEQ 836 | 167 | PRSPS | −1.43 | | | −1.14 | PVX_000815_sporozoite invasion-associated protein 1 |
| DEN4 | SEQ 837 | 223 | AGADT | −1.32 | | | −1.42 | PVX_089985_hypothetical protein |
| DEN4 | SEQ 838 | 256 | SQEGA | −1.04 | −1.60 | PF3D7_0212300_peptide chain release factor subunit 1 | −1.90 | PVX101355_protein phosphatase PPM4 |
| DEN4 | SEQ 839 | 266 | AGATE | −1.03 | −1.29 | PF3D7_0425800_erythrocyte membrane protein 1 | −1.15 | PVX_081425_2-C-methyl-D-erythritol 4-phosphate cytidyly transferase |
| DEN4 | SEQ 840 | 267 | GATEV | −1.32 | −1.19 | PF3D7_0425800_erythrocyte membrane protein 1 | −1.00 | PVX_111535_hypothetical protein |
| DEN4 | SEQ 841 | 271 | VDSGD | −1.78 | 0.05 | PF3D7_0905700.1_autophagy-related protein 3 | −1.29 | PVX_081575_hypothetical protein |
| DEN4 | SEQ 842 | 272 | DSGDG | −1.62 | −1.73 | PE3D7_1200600_erythrocyte membrane protein 1 | −1.47 | PVX_100910_transcription factor with AP2 domain(s) |
| DEN4 | SEQ 843 | 273 | SGDGN | −1.34 | −1.84 | PE3D7_0712000_erythrocyte membrane protein 1 | −0.82 | PVX_017140_unspecified |
| DEN4 | SEQ 844 | 274 | GDGNH | −1.01 | | | −1.22 | PVX_051690_unspecified |
| DEN4 | SEQ 845 | 314 | AETQH | −1.29 | | | −1.21 | PVX_115135_hypothetical protein |
| DEN4 | SEQ 846 | 328 | EGAGA | −1.44 | −1.69 | PE3D7_0425800_erythrocyte membrane protein 1 | −1.48 | PVX_073690_unspecified |
| DEN4 | SEQ 847 | 359 | AENTN | −1.18 | −1.30 | PE3D7_0708700_Cg8 protein | −1.34 | PVX_090990_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN4 | SEQ 848 | 361 | NTNSV | -1.19 | -0.78 | PE3D7_0802100_transcription factor with AP2 domain(s) (ApiAP2) | -1.20 | PVX_086285_hypothetical protein |
| DEN4 | SEQ 849 | 371 | EPPFG | -1.01 | | | -1.11 | PVX_118340_serine_threonine protein kinase |
| DEN4 | SEQ 850 | 470 | NSRNT | -1.57 | -1.06 | PE3D7_0110800_transcription initiation factor TFIIB | -0.95 | PVX_117645_hypothetical protein |
| DEN4 | SEQ 851 | 471 | SRNTS | -1.42 | -1.36 | PE3D7_1469600_biotin carboxylase subunit of acetyl CoA carboxylase | -1.35 | PVX_118062_chloroquine resistance marker protein |
| YF | SEQ 852 | 3 | DKPSL | -1.35 | -1.05 | PF3D7_0520100_protein phosphatase PPM9 | | |
| YF | SEQ 853 | 52 | DRPAE | -1.04 | | | -1.54 | PVX_096090_exonuclease 1 |
| YF | SEQ 854 | 76 | PSTGE | -1.69 | | | -1.77 | PVX_097885_hypothetical protein |
| YF | SEQ 855 | 77 | STGEA | -1.30 | | | -1.47 | PVX_082980_GPI mannosyltransferase 3 |
| YF | SEQ 856 | 84 | AEENE | -1.55 | -0.70 | PF3D7_1348200_step II splicing factor | -1.18 | PVX_0019.55_schizont egress antigen-1 |
| YF | SEQ 857 | 85 | EENEG | -1.83 | -1.70 | PF3D7_0500800_mature parasite-infected erythrocyte surface antigen (MESA) | -1.50 | PVX_116660_Micro-fibrillar-associated protein 1 C-terminus domain containing protein |
| YF | SEQ 858 | 86 | ENEGD | -1.95 | -1.74 | PF3D7_1332200_conserved *Plasmodium* protein | -1.76 | PVX_089085_protein KRII |
| YF | SEQ 859 | 87 | NEGDN | -1.83 | -1.38 | PF3D7_1412600_deoxyhypusine synthase (DHS) | -1.29 | PVX_119310_lipoamide acyltransferase component of branched-chain alpha-keto acid dehydrogenase complex |
| YF | SEQ 860 | 96 | TYSDR | -1.18 | -0.68 | PF3D7_0418600_regulator of chromosome condensation | -1.20 | PVX_013120_unspecified |
| YF | SEQ 861 | 148 | AKQEN | -1.02 | | | -1.25 | PVX_094275_hypothetical protein |
| YF | SEQ 862 | 164 | ALSGS | -1.15 | -1.04 | PF3D7_0629100_nicotinate phosphoribosyltransferase | -0.94 | PVX_169270_unspecified |
| YF | SEQ 863 | 165 | LSGSQ | -1.22 | -1.30 | PF3D7_0704000_conserved *Plasmodium* membrane protein | -1.51 | PVX_117205_hypothetical protein |
| YF | SEQ 864 | 166 | SGSQE | -1.09 | -1.15 | PF3D7_0712600_erythrocyte membrane protein 1 | -1.75 | PVX_116765_variant-silencing SET protein |

TABLE 22-continued

| Virus | | Pos in virus env | BEPI penta | BEPI (virus) | P_falciparum BEPI (standard uTOPE) | gi: curation | P. vivax BEPI (standard uTOPE) | gi: curation (P_vivax) |
|---|---|---|---|---|---|---|---|---|
| YF | SEQ 865 | 219 | QSGSG | -1.09 | | | -1.99 | PVX_114512_eukaryotic translation initiation factor 2-alpha kinase |
| YF | SEQ 866 | 220 | SGSGG | -1.16 | -2.11 | PF3D7_0300100_erthrocyte membrane protein 1 | -2.35 | PVX_123205_CCR4-associated factor 1 |
| YF | SEQ 867 | 221 | GSGGV | -1.05 | -1.49 | PF3D7_1373500_erythrocyte membrane protein 1 | -1.57 | PVX_089655_ubiquitin carboxyl-terminal hydrolase 13 |
| YF | SEQ 868 | 249 | GNQEG | -1.42 | | | -1.75 | PVX_122250_hypothetical protein |
| YF | SEQ 869 | 250 | NQEGS | -1.50 | -0.31 | PF3D7_0108700_secreted ookinete protein | -1.17 | PVX_114512_eukaryotic translation initiation factor 2-alpha kinase |
| YF | SEQ 870 | 251 | QEGSL | -1.41 | -1.04 | PF3D7_0617400_erythrocyte membrane protein 1 | -1.36 | PVX_001040_transcription factor with AP2 domain(s) |
| YF | SEQ 871 | 265 | VTKDT | -1.36 | -1.04 | PF3D7_1009200_small subunit rRNA synthesis-associated protein | | |
| YF | SEQ 872 | 266 | TKDTN | -1.62 | -1.46 | PF3D7_0600200_erythrocyte membrane protein 1 | -1.75 | PVX_000730_exosome complex component RRP4 |
| YF | SEQ 873 | 267 | KDTND | -1.73 | -1.11 | PF3D7_1018200_serine_threonine protein phosphatase 8 | -1.70 | PVX_111090_hypothetical protein |
| YF | SEQ 874 | 268 | DTNDN | -1.75 | -1.94 | PF3D7_1428400_WD and tetratricopeptide repeats protein 1 | -0.81 | PVX_113750_eukaryotic translation initiation factor 3 subunit 6 interacting protein |
| YF | SEQ 875 | 269 | TNDNN | -1.55 | -1.90 | PF3D7_1428400_WD and tetratricopeptide repeats protein 1 | -1.30 | PVX_119270_exportin-1 |
| YF | SEQ 876 | 309 | KNPTD | -122 | -1.06 | PF3D7_1136900_subtilisin-like protease 2 (SUB2) | -0.98 | PVX_092210_hypothetical protein |
| YF | SEQ 877 | 310 | NPTDT | -1.81 | | | -1.03 | PVX_092535_Adenylate and Guanylate cyclase catalytic domain containing protein |
| YF | SEQ 878 | 313 | DTGHG | -1.59 | | | -1.31 | PVX_054190_unspecified |
| YF | SEQ 879 | 314 | TGHGT | -1.04 | | | -1.31 | PVX_113390_hypothetical protein |
| YF | SEQ 880 | 326 | SKGAP | -1.20 | -0.52 | PF3D7_1453400_conserved *Plasmodium* protein | -1.75 | PVX_086245_nuclear formin-like protein |
| YF | SEQ 881 | 327 | KGAPC | -1.05 | | | -1.03 | PVX_083220_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| YF | SEQ 882 | 357 | ASTND | −1.54 | −0.95 | PF3D7_0917100_N-glycosylasc_DNA lyase | −1.03 | PVX_00650_sentrin-specific protease 1 |
| YF | SEQ 883 | 358 | STNDD | −1.30 | −1.46 | PF3D7_1345100_thioredoxin 2 (TRX2) | −1.16 | PVX_085130_transporter |
| YF | SEQ 884 | 369 | NPPFG | −1.03 | | | −1.11 | PVX_002680_hypothetical protein |
| YF | SEQ 885 | 391 | HKEGS | −1.06 | −0.27 | PF3D7_9209000_6-cysteine protein (P230) | −1.11 | PVX_110920_acetyl-CoA transporter |
| YF | SEQ 886 | 392 | KEGSS | −1.27 | −0.47 | PF3D7_0209000_6-cysteine protein (P230) | −2.07 | PVX_000945_apical sushi protein |
| YF | SEQ 887 | 394 | GSSIG | −1.01 | −0.38 | PF3D7_1431600_ATP-specific succinyl-CoA synthetase beta subunit | −1.25 | PVX_123970_ataxin-3 |
| DEN2 | SEQ 888 | 37 | KNKPT | −1.25 | −1.63 | PF3D7_0201900_erythrocyte membrane protein 3 (EMP3) | −1.31 | PVX_099980_merozoite surface protein 1 (MSP1) |
| DEN2 | SEQ 889 | 50 | EAKQP | −1.80 | −1.16 | PF3D7_0306900_40S ribosomal protein S23 | −1.00 | PVX_119470_40S ribosomal protein S23 |
| DEN2 | SEQ 890 | 69 | TTTES | −1.58 | −0.92 | PF3D7_0223500_erythrocyte membrane protein 1 | −1.37 | PVX_000735_protein phosphatase PPM1 |
| DEN2 | SEQ 891 | 70 | TTESR | −1.44 | | | −1.25 | PVX_013625_unspecified |
| DEN2 | SEQ 892 | 73 | SRCPT | −1.60 | | | −1.03 | PVX_093705_variable surface protein Vir18 |
| DEN2 | SEQ 893 | 75 | CPTQG | −1.88 | | | −1.05 | PVX_095125_hypothetical protein |
| DEN2 | SEQ 894 | 76 | PTQGE | −1.88 | | | −2.04 | PVX_084330_hypothetical protein |
| DEN2 | SEQ 895 | 77 | TQGEP | −1.76 | | | −1.17 | PVX_099635_conserved *Plasmodium* protein |
| DEN2 | SEQ 896 | 78 | QGEPS | −1.51 | | | −1.20 | PVX_099635_conserved *Plasmodium* protein |
| DEN2 | SEQ 897 | 84 | NEEQD | −1.28 | −1.45 | PF3D7_0408700_sporozoite micronemal protein essential for cell traversal (PLP1) | −1.66 | PVX_094890_hypothetical protein |
| DEN2 | SEQ 898 | 85 | EEQDK | −1.0 | −0.93 | PF3D7_1472800_conserved *Plasmodium* protein | −1.31 | PVX_091570_myosin light chain B |
| DEN2 | SEQ 899 | 146 | SGEEH | −1.20 | −0.85 | PF3D7_0800300_erythrocyte membrane protein 1 | −1.47 | PVX_116680_vacuolar protein sorting-associated protein 52 |
| DEN2 | SEQ 900 | 147 | GEEHA | −1.18 | | | −1.30 | PVX_100970_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN2 | SEQ 901 | 153 | GNDTG | −1.72 | −0.44 | PF3D7_0703500_erythrocyte membrane-associated antigen | −1.69 | PVX_088045_hypothetical protein |
| DEN2 | SEQ 902 | 154 | NDTGK | −1.88 | −1.00 | PE3D7_1105500_centrin-4 (CEN4) | −0.80 | PVX_090955_centrin-4 |
| DEN2 | SEQ 903 | 155 | DTGKH | −1.99 | −1.01 | PF3D7_0305100_conserved *Plasmodium* protein | −0.96 | PVX_114725_metacaspase 1 |
| DEN2 | SEQ 904 | 156 | TGKHG | −1.96 | −1.53 | PF3D7_1204300_eukaryotic translation initiation factor 5A (EIF5A) | −1.00 | PVX_003635_hypothetical protein |
| DEN2 | SEQ 905 | 157 | GKHMK | −1.61 | −1.79 | PF3D7_1234600_conserved *Plasmodium* protein | −0.82 | PVX_081755_hypothetical protein |
| DEN2 | SEQ 906 | 158 | KHGKE | −1.22 | −1.47 | PF3D7_1444500_eukaryotic initiation factor 2alpha kinase 1 (IK1) | −0.13 | PVX_123283_JmjC domain containing protein (JmjC1) |
| DEN2 | SEQ 907 | 166 | TPQSS | −1.92 | | | −1.01 | PVX_003795_serine-repeat antigen (SERA) |
| DEN2 | SEQ 908 | 167 | PQSST | −2.13 | | | −1.09 | PVX_114115_hypothetical protein |
| DEN2 | SEQ 909 | 168 | QSSTT | −2.09 | −1.35 | PF3D7_0520100_protein phosphatase PPM9 | | |
| DEN2 | SEQ 910 | 169 | SSTTE | −1.92 | −1.81 | PF3D7_0420900_erythrocyte membrane protein 1 | −1.73 | PVX_097835_DNA mismatch repair protein MSH6 |
| DEN2 | SEQ 911 | 170 | STTEA | −1.80 | −2.02 | PF3D7_0502600_conserved *Plasmodium* protein | −1.25 | PVX_122240_carbamoyl phosphate synthetase |
| DEN2 | SEQ 912 | 171 | TTEAE | −1.50 | | | −1.60 | PVX_097705_merozoite surface protein 3 (MSP3_8) |
| DEN2 | SEQ 913 | 224 | GADTQ | −1.55 | | | −1.49 | PVX_004537_VIR protein |
| DEN2 | SEQ 914 | 225 | ADTQG | −1.62 | −0.31 | PF3D7_1020300_cytoplasmic dynein intermediate chain | −1.09 | PVX_088215_hypothetical protein |
| DEN2 | SEQ 915 | 226 | DTQGS | −1.65 | | | −1.42 | PVX_087780_phosphopantetheine adenylyltransferase |
| DEN2 | SEQ 916 | 227 | TQGSN | −1.45 | −1.20 | PF3D7_1112300_conserved *Plasmodium* protein | −1.97 | PVX_073690_unspecified |
| DEN2 | SEQ 917 | 244 | PHAKK | −1.44 | −0.50 | PF3D7_1412100_conserved *Plasmodium* protein | −1.32 | PVX_091105_endoplasmic reticulum resident calcium binding protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN2 | SEQ 918 | 314 | AETQH | -1.05 | | | -1.21 | PVX_115135_hypothetical protein |
| DEN2 | SEQ 919 | 327 | YFGDG | -1.54 | | | -1.32 | PVX_003645_hypothetical protein |
| DEN2 | SEQ 920 | 328 | EGDGS | -1.74 | -1.63 | PF3D7_1035800_probable protein | -1.94 | PVX_089085_protein KR11 |
| DEN2 | SEQ 921 | 329 | GDGSP | -1.64 | | | -1.97 | PVX_122940_hypothetical protein |
| DEN2 | SEQ 922 | 330 | DGSPC | -1.27 | -1.04 | PF3D7_1240600_erythrocyte membrane protein 1 | -0.76 | PVX_092345_DNA-directed RNA polymerase 1 subunit RPA2 |
| DEN2 | SEQ 923 | 360 | TEKDS | -1.11 | | | -1.75 | PVX_084195_origin recognition complex subunit 1 |
| DEN2 | SEQ 924 | 361 | EKDSP | -1.19 | -2.14 | PF3D7_0624600_SNF2 helicase | -1.74 | PVX_092945_sporozoite and liver stage asparagine-rich protein (KARP) |
| DEN2 | SEQ 925 | 363 | DSPVN | -1.24 | -0.80 | PF3D7_1104500_WD repeat-containing protein | -1.20 | PVX_123935_haloacid dehalogenase-like hydrolase |
| DEN2 | SEQ 926 | 369 | EAEPP | -1.31 | | | -1.29 | PVX_122665_hypothetical protein |
| DEN2 | SEQ 927 | 371 | EPPFG | -1.48 | | | -1.11 | PVX_118340_serine_threonine protein kinase |
| DEN2 | SEQ 928 | 372 | PPFGD | -1.14 | | | -1.28 | PVX_081330_LCCL domain-containing protein (CCp5) |
| DEN2 | SEQ 929 | 396 | GSSIG | -1.02 | -0.38 | PF3D7_1431600_ATP-specific succinyl-CoA synthetase beta subunit | -1.25 | PVX_123970_ataxin-3 |
| DEN2 | SEQ 930 | 471 | SRSTS | -1.34 | -1.54 | PF3D7_0207700_serine repeat antigen 4 (SERA4) | -1.54 | PVX_111025_vesicle transport-related protein |
| DEN2 | SEQ 931 | 472 | RSTSL | -1.32 | -1.05 | PF3D7_0410000_erythrocyte vesicle protein 1 (EVP1) | 0.73 | PVX_116655_hypothetical protein |
| DEN1 | SEQ 932 | 38 | KNKPT | -1.29 | -1.63 | PF3D7_0201900_erythrocyte membrane protein 3 (EMP3) | -1.31 | PVX_099980_merozoite surface protein 1 (MSP1) |
| DEN1 | SEQ 933 | 67 | ISNTT | -1.82 | -0.10 | PF3D7_0712500_rifin | -1.16 | PVX_032190_unspecified |
| DEN1 | SEQ 934 | 68 | SNTTT | -2.05 | -1.79 | PF3D7_1013500_phosphoinositide-specific phospholipase C (PI-PLC) | -1.56 | PVX_092570_transcription factor with AP2 domain(s) |
| DEN1 | SEQ 935 | 69 | NTTTD | -1.95 | -1.47 | PF3D7_1443600_conserved *Plasmodium* protein | -0.53 | PVX_100705_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN1 | SEQ 936 | 70 | TTTDS | -1.67 | -1.50 | PFD7_0902200_serine_threonine protein kinase | -1.35 | PVX_114955_hypothetical protein |
| DEN1 | SEQ 937 | 71 | TTDSR | -1.49 | -1.44 | PF3D7_1418100_liver specific protein 1 | -1.47 | PVX_114955_hypothetical protein |
| DEN1 | SEQ 938 | 74 | SRCPT | -1.74 | | | -1.03 | PVX_093705_variable surface protein Vir18 |
| DEN1 | SEQ 939 | 76 | CPTQG | -1.75 | | | -1.05 | PVX_095125_hypothetical protein |
| DEN1 | SEQ 940 | 77 | PTQGE | -1.52 | | | -2.04 | PVX_084330_hypothelical protein |
| DEN1 | SEQ 941 | 78 | TQGEA | -1.16 | -1.74 | PF3D7_1240400_erythrocyte membrane protein 1 | -1.33 | PVX_018660_unspecified |
| DEN1 | SEQ 942 | 152 | QVGNE | -1.47 | -1.21 | PF3D7_1255200_erythrocyte membrane protein | -0.91 | PVX_098950_hypothetical protein |
| DEN1 | SEQ 943 | 154 | GNETT | -1.54 | -1.54 | PF3D7_0314700_zinc finger protein | -1.57 | PVX_096075_hypothetical protein |
| DEN1 | SEQ 944 | 155 | NETTE | -1.66 | -1.40 | PF3D7_0302200_cytoadherence linked asexual protein 32 (CLAG3_2) | -1.60 | PVX_097800_hypothetical protein |
| DEN1 | SEQ 945 | 158 | TEHGT | -1.03 | | | -1.14 | PVX_080150_hypothetical protein |
| DEN1 | SEQ 946 | 170 | APTSE | -1.50 | | | -1.46 | PVX_089950_bifunctional dihydrofolate reductase-thymidylate synthase |
| DEN1 | SEQ 947 | 188 | SPRTG | -1.08 | | | -1.85 | PVX_116604_hypothetical protein |
| DEN1 | SEQ 948 | 224 | SGAST | -1.72 | -1.41 | PF3D7_1015900_enolase (ENO) | -1.23 | PVX_095015_enolase |
| DEN1 | SEQ 949 | 225 | GASTS | -1.99 | -2.01 | PF3D7_0475800_erythrocyte membrane protein 1 | -0.86 | PVX_047190_unspecified |
| DEN1 | SEQ 950 | 226 | ASTSQ | -2.09 | -0.75 | PF3D7_1437200_ribonucleoside-diphosphate reductase | -1.36 | PVX_119790_hypothetical protein |
| DEN1 | SEQ 951 | 227 | STSQE | -2.09 | -2.24 | PF3D7_0215300_acyl-CoA synthetase (ACS8) | -1.36 | PVX_068190_unspecified |
| DEN1 | SEQ 952 | 273 | QTSGT | -1.49 | -1.97 | PF3D7_1240300_erythrocyte membrane protein 1 | | |
| DEN1 | SEQ 953 | 275 | SGTTT | -1.00 | -1.82 | PF3D7_0905100_nucleoporin NUP100_NSP100 | -1.52 | PVX_031690_unspecified |
| DEN1 | SEQ 954 | 315 | AETQH | -1.29 | | | -1.21 | PVX_115135_hypothetical protein |

TABLE 22-continued

| Virus | | Pos in virus env | BEPI penta | BEPI (virus) | P_faclciparum BEPI (standard uTOPE) | gi: curation | *P. vivax* BEPI (standard uTOPE) | gi: curation (P_vivax) |
|---|---|---|---|---|---|---|---|---|
| DEN1 | SEQ 955 | 328 | YFGTD | −1.47 | −0.80 | PF3D7_1453900_conserved *Plasmodium* protein | −1.23 | PVX_090150_erythrocyte membrane-associated antigen |
| DEN1 | SEQ 956 | 329 | EGTDA | −1.55 | | | −1.55 | PVX_030190_unspecified |
| DEN1 | SEQ 957 | 342 | QDEKG | −1.10 | −1.11 | PF3D7_0400400_erythrocyte membrane protein 1 | −1.22 | PVX_116765_variant-silencing SET protein |
| DEN1 | SEQ 958 | 343 | DEKGV | −1.49 | −1.52 | PF3D7_1418100_liver specific protein 1 | 0.10 | PVX_095145_hypothetical protein |
| DEN1 | SEQ 959 | 347 | VTQNG | −1.23 | −1.47 | PF3D7_1421300_conserved_Plasmodium protein | −0.88 | PVX_085877_conserved *Plasmodium* protein |
| DEN1 | SEQ 960 | 363 | KEKPV | −1.10 | −1.49 | PF3D7_0712600_erythrocyte membrane protein 1 | | PVX_089925_hypothetical protein |
| DEN1 | SEQ 961 | 370 | ETEPP | −1.39 | −1.12 | PF3D7_0500800_mature parasite-infected erythrocyte surface antigen (MESA) | | |
| DEN1 | SEQ 962 | 372 | EPPFG | −1.44 | | | −1.11 | PVX_118340_serine_threonine protein kinase |
| DEN1 | SEQ 963 | 472 | SRSTS | −1.34 | −1.54 | PF3D7_0207700_serine repeat antigen 4 (SERA4) | −1.54 | PVX_111025_vesicle transport-related protein |
| DEN1 | SEQ 964 | 473 | RSTSL | −1.20 | −1 05 | PF3D7_0410000_erythrocyte vesicle protein 1 (EVP1) | 0.73 | PVX_116655_hypothetical protein |

TABLE 23

| Virus | BEPIpenta | | Pos in NS1 | BEPI (virus) | *P. falciparum* BEPI (standard uTOPE) | gi: curation | P_vivax BEPI (standard uTOPE) | gi: curation (P_vivax) |
|---|---|---|---|---|---|---|---|---|
| DEN3 | DSPKR | SEQ 647 | 38 | -1.34 | | | -1.44 | PVX_088915_hypothetical protein |
| DEN3 | QGKRT | SEQ 1246 | 100 | -1.07 | -0.25 | PF3D7_1321300_conserved *Plasmodium* membrane protein | -1.20 | PVX_123915_hypothetical protein |
| DEN3 | VTAET | SEQ 965 | 125 | -1.22 | | | -1.08 | PVX_019165_unspecified |
| DEN3 | TAETQ | SEQ 966 | 126 | -1.29 | -1.48 | PF3D7_0700100_erythrocyte membrane protein 1 | -0.76 | PVX_111180_28 kDa ookinete surface protein |
| DEN3 | ETQNS | SEQ 967 | 128 | -1.07 | -1.78 | PF3D7_0815600_eukaryotic translation initiation factor 3 subunit G | -1.59 | PVX_089625_eukaryotic translation initiation factor 3 subunit 4 |
| DEN3 | NTPEC | SEQ 968 | 140 | -1.80 | | | -1.28 | PVX_100620_hypothetical protein |
| DEN3 | TPECP | SEQ 969 | 141 | -1.73 | | | -1.19 | PVX_086285_hypothetical protein |
| DEN3 | CPSAS | SEQ 970 | 144 | -1.14 | -0.98 | PF3D7_1355100_DNA replication licensing factor MCM6 (MCM6) | -1.31 | PVX_085195_hypothetical protein |
| DEN3 | SQKNG | SEQ 971 | 205 | -1.16 | -1.54 | PF3D7_0314700_zinc finger protein | -1.05 | PVX_120845_unspecified |
| DEN3 | QKNGS | SEQ 972 | 206 | -1.28 | -1.02 | PF3D7_1319600_conserved *Plasmodium* protein | -1.29 | PVX_098655_hypothetical protein |
| DEN3 | KNGSW | SEQ 973 | 207 | -1.32 | -0.62 | PF3D7_1203600_cytochrome c1 heme lyase | -1.23 | PVX_114260_transcription factor with AP2 domain(s) |
| DEN3 | GTRGP | SEQ 974 | 293 | -1.65 | | | -1.80 | PVX_092925_CCAAT-box DNA binding protein subunit B |
| DEN3 | TRGPS | SEQ 975 | 294 | -1.55 | | | -1.36 | PVX_132260_unspecified |
| DEN3 | SEKEE | SEQ 976 | 340 | -1.11 | -1.41 | PF3D7_1140000_carbonic anhydrase (CA) | -0.45 | PVX_213290_unspecified |
| DEN3 | EKEEN | SEQ 977 | 341 | -1.11 | -1.66 | PF3D7_0500800_mature parasite-infected erythrocyte surface antigen (MESA) | -0.70 | PVX_238290_unspecified |
| DEN4 | FQPES | SEQ 978 | 35 | -1.41 | -0.42 | PF3D7_0720800_Hand-like protein | -1.36 | PVX_098620_hypothetical protein |
| DEN4 | PESPA | SEQ 979 | 37 | -1.64 | | | -1.31 | PVX_119380_hypothetical protein |

TABLE 23-continued

| Virus | BEPIpenta | | Pos in NS1 | BEPI (virus) | *P. falciparum* BEPI (standard uTOPE) | gi: curation | P_vivax BEPI (standard uTOPE) | gi: curation (P_vivax) |
|---|---|---|---|---|---|---|---|---|
| DEN4 | ESPAR | SEQ 980 | 38 | −1.42 | −2.04 | PF3D7_0600200_erythrocyte membrane protein 1 | −1.87 | PVX_114405_hypothetical protein |
| DEN4 | TPPVS | SEQ 981 | 106 | −1.07 | | | −1.03 | PVX_081495_hypothetical protein |
| DEN4 | GPDTS | SEQ 982 | 138 | −1.37 | −1.47 | PF3D7_1200400_erythrocyte membrane protein 1 | | |
| DEN4 | TSECP | SEQ 983 | 141 | −1.74 | | | −1.28 | PVX_084715_hypothetical protein |
| DEN4 | REGSS | SEQ 984 | 173 | −1.07 | −2.13 | PF3D7_1351700_inner membrane complex protein 1f | −1.73 | PVX_001040_transcription factor with AP2 domain(s) |
| DEN4 | EGSSE | SEQ 985 | 174 | −1.25 | −2.04 | PF3D7_0733000_erythrocyte membrane protein 1 | −1.36 | PVX_097583_skeleton-binding protein 1 |
| DEN4 | GSSEV | SEQ 986 | 175 | −1.10 | −0.48 | PF3D7_0600400_erythrocyte membrane protein 1 | −1.16 | PVX_016140_unspecified |
| DEN4 | SSKNQ | SEQ 987 | 205 | −1.02 | −1.97 | PF3D7_1228300_NIMA related kinase 1 (NEK1) | −0.89 | PVX_000525_protein kinase domain containing protein |
| DEN4 | TTTAS | SEQ 988 | 301 | −1.51 | −1.28 | PF3D7_0716800_eukaryotic translation initiation factor 3 subunit 1 | −1.12 | PVX_049690_unspecified |
| DEN4 | TTASG | SEQ 989 | 302 | −1.33 | −1.73 | PF3D7_0712900_erythrocyte membrane protein 1 | −1.87 | PVX_113460_DNA repair protein RAD50 |
| DEN4 | TASGK | SEQ 990 | 303 | −1.09 | −1.72 | PF3D7_0712900_erythrocyte membrane protein 1 | −0.62 | PVX_118455_clathrin coat assembly protein AP50 |
| DEN4 | LSEKE | SEQ 991 | 339 | −1.08 | −1.11 | PF3D7_1301800_surface-associated interspersed protein 13_1 (SURFIN 13 1) | −0.30 | PVX_014125_unspecified |
| DEN4 | SEKEE | SEQ 992 | 340 | −1.18 | −1.41 | PF3D7_1140000_carbonic anhydrase (CA) | −0.45 | PVX_213290_unspecified |
| DEN4 | EKEEN | SEQ 993 | 341 | −1.20 | −1.66 | PF3D7_0500800_mature parasite-infected erythrocyte surface antigen (MESA) | −0.70 | PVX_238290_unspecified |
| YF | SPGRK | SEQ 994 | 126 | −1.38 | | | −1.21 | PVX_114115_hypothetical protein |
| YF | PGRKN | SEQ 995 | 127 | −1.36 | −1.22 | PF3D7_1325900_conserved *Plasmodium* protein | −1.28 | PVX_119750_ubiquitin-protein ligase |
| YF | GRKNG | SEQ 996 | 128 | −1.10 | | | −1.66 | PVX_069690_unspecified |

TABLE 23-continued

| Virus | BEPIpenta | | Pos in NS1 | BEPI (virus) | *P. falciparum* BEPI (standard uTOPE) | gi: curation | P_vivax BEPI (standard uTOPE) | gi: curation (P_vivax) |
|---|---|---|---|---|---|---|---|---|
| YF | KSRKE | SEQ 997 | 139 | -1.23 | -1.70 | PF3D7_0215800_origin recognition complex subunit 5 (ORC5) | -1.77 | PVX_097000_Plasmodium exported ptotein |
| YF | VNGKK | SEQ 998 | 189 | -1.24 | -0.81 | PF3D7_0201900_erythrocyte membrane protein 3 (EMP3) | -1.06 | PVX_003735_DNA repair protein RAD2 |
| YF | NGKKS | SEQ 999 | 190 | -1.61 | -0.85 | PF3D7_0709300_Cg2 protein (CG2) | -1.24 | PVX_123855_histone chaperone ASF1 |
| YF | GKKSA | SEQ 1000 | 191 | -2.00 | -1.36 | PF3D7_0400400_erythrocyte membrane protein 1 | -1.88 | PVX_116985_biotin carboxylase subunit of acetyl CoA carboxylase |
| YF | SAHGS | SEQ 1001 | 194 | -2.17 | | | -1.21 | PVX_091015_protein kinase |
| YF | AHGSP | SEQ 1002 | 195 | -1.82 | | | -1.54 | PVX_091015_protein kinase |
| YF | GGPVS | SEQ 1003 | 249 | -1.34 | | | -1.39 | PVX_101355_protein phosphatase PPM4 |
| YF | VQTNG | SEQ 1004 | 263 | -1.00 | -0.10 | PF3D7_1442400_conserved *Plasmodium* protein | -1.09 | PVX_118340_serine_threonine protein kinase |
| YF | GNCDG | SEQ 1005 | 290 | -1.04 | | | -1.15 | PVX_001850_hypothetical protein |
| YF | DGRGK | SEQ 1006 | 293 | -2.00 | | | -1.05 | PVX_100970_hypothetical protein |
| YF | GRGKS | SEQ 1007 | 294 | -2.03 | -1.46 | PE3D7_1020700_histone acetyltransferase | -1.03 | PVX_116765_variant-silencing SET protein |
| YF | RGKST | SEQ 1008 | 295 | -2.05 | | | -1.45 | PVX_097965_hypothetical protein |
| YF | GKSTR | SEQ 1009 | 296 | -2.14 | -1.17 | PF3D7_1111100_replication factor C subunit 5 | -1.06 | PVX_089935_hypothetical protein |
| YF | KSTRS | SEQ 1010 | 297 | -2.36 | -1.48 | PF3D7_1413700_conserved *Plasmodium* protein | -1.60 | PVX_086050_hypothetical protein |
| YF | STRST | SEQ 1011 | 298 | -2.62 | | | -1.21 | PVX_093655_sentrin-specilic protease 2 |
| YF | TRSTT | SEQ 1012 | 299 | -2.73 | -1.05 | PF3D7_1479400_rifin (RIF) | -0.84 | PVX_065690_unspecified |
| YF | STTDS | SEQ 1013 | 301 | -2.15 | -1.60 | PF3D7_0600600_erythrocyte membrane protein 1 (PfEMP1) | -1.27 | PVX_094255_reticulocyte binding protein 2b (RBP2b) |
| YF | TTDSG | SEQ 1014 | 302 | -1.81 | -0.94 | PE3D7_1333000_20 kDa chaperonin (CPN20) | -1.10 | PVX_092630_hypothetical protein |

TABLE 23-continued

| Virus | BEPIpenta | Pos in NS1 | BEPI (virus) | *P. falciparum* BEPI (standard uTOPE) | gi: curation | P_vivax BEPI (standard uTOPE) | gi: curation (P_vivax) |
|---|---|---|---|---|---|---|---|
| YF | TDSGK SEQ 1015 | 303 | -1.47 | -1.90 | PF3D7_0412400_erythrocyte membrane protein 1 | -0.86 | PVX_000970_pre-mRNA-processing-splicing factor 8 |
| YF | DSGKV SEQ 1016 | 304 | -1.10 | -0.22 | PF3D7_0821300_ATP-dependent RNA helicase prh1 | -1.13 | PVX_089015_ATP-dependent RNA helicase DBP10 |
| YF | RKTHE SEQ 1017 | 339 | -1.14 | -1.07 | PE3D7_0302000_pre-mRNA-splicing factor PRP46 | -1.31 | PVX_088940_hypothetical protein |
| WNV | PETPQ SEQ 1018 | 38 | -1.69 | -2.30 | PF3D7_0937800_erythrocyte membrane protein 1 | | PVX_096070_early transcribed membrane protein (ETRAMP) |
| WNV | ETPQG SEQ 1019 | 39 | -1.27 | -1.22 | PF3D7_1366300_conserved *Plasmodium* protein | -1.71 | PVX_081205_TatD-like deoxyribonuclease |
| WNV | APKRL SEQ 1020 | 102 | -1.16 | -0.22 | PF3D7_1465800_dynein beta chain | -1.19 | PVX_095355_kinesin-5 (EG5) |
| WNV | PETKE SEQ 1021 | 140 | -1.48 | -1.57 | PF3D7_1373500_erythrocyte membrane protein 1 | -1.07 | PVX_113990_mitochondrial import receptor subunit TOM40 |
| WNV | CPTQN SEQ 1022 | 145 | -1.29 | -1.12 | PF3D7_1334000_conserved *Plasmodium* protein | | |
| WNV | RESNT SEQ 1023 | 174 | -1.48 | -1.22 | PF3D7_1120600_conserved *Plasmodium* protein | -0.94 | PVX_002680_hypothetical protein |
| WNV | ESNTT SEQ 1024 | 175 | -1.94 | -1.29 | PF3D7_0809100_erythrocyte membrane protein 1 | -1.30 | PVX_145260_unspecified |
| WNV | SNTTE SEQ 1025 | 176 | -2.02 | -2.02 | PF3D7_1368800_DNA repair endonuclease | -1.16 | PVX_145260_unspecified |
| WNV | AGPRS SEQ 1026 | 250 | -1.48 | -1.16 | PF3D7_0816500_small heat shock protein HSP20 | | |
| WNV | RSNHN SEQ 1027 | 253 | -1.54 | -1.23 | PF3D7_1367700_alanine--tRNA ligase (AlaRS) | -1.37 | PVX_118425_serin_threonine protein kinase |
| WNV | RGPAT SEQ 1028 | 296 | -1.56 | -1.64 | PF3D7_0600200_erythrocyte membrane protein 1 | -0.72 | PVX_113645_hypothetical protein |
| WNV | ATRTT SEQ 1029 | 299 | -2.20 | | | -1.13 | PVX_117340_hypothetical protein |
| WNV | TRTTT SEQ 1030 | 300 | -2.28 | -1.27 | PF3D7_0901000_rifin (RIF) | -0.96 | PVX_085275_60S ribosomal protein L5 |
| WNV | RTTTE SEQ 1031 | 301 | -2.27 | | | -1.40 | PVX_099295_hypothetical protein |

TABLE 23-continued

| Virus | BEPIpenta | | Pos in NS1 | BEPI (virus) | *P. falciparum* BEPI (standard uTOPE) | gi: curation | P_vivax BEPI (standard uTOPE) | gi: curation (P_vivax) |
|---|---|---|---|---|---|---|---|---|
| WNV | TTTES | SEQ 1032 | 302 | -1.91 | -0.92 | PF3D7_0223500_erythrocyte membrane protein 1 | -1.37 | PVX_000735_protein phosphatase PPM1 |
| WNV | TTESG | SEQ 1033 | 303 | -1.54 | -1.49 | PF3D7_0209000_6-cysteine protein (P230) | -0.91 | PVX_071190_unspecified |
| WNV | TESGK | SEQ 1034 | 304 | -1.18 | -2.56 | PF3D7_1459200_WD repeat-containing protein | -0.59 | PVX_115490_VIR protein |
| DEN1 | DSPKR | SEQ 1035 | 38 | -1.45 | | | -1.44 | PVX_088915_hypothetical protein |
| DEN1 | GPDTP | SEQ 1036 | 138 | -1.38 | | | -1.51 | PVX_090230_early transcribed membrane protein (ETRAMP) |
| DEN1 | IPECP | SEQ 1037 | 141 | -1.84 | | | -1.19 | PVX_086285_hypothetical protein |
| DEN1 | ECPDG | SEQ 1038 | 143 | -1.53 | | | -1.20 | PVX_131260_unspecified |
| DEN1 | SEKNE | SEQ 1039 | 205 | -1.12 | -0.35 | PF3D7_1403900_serin_threonine protein phosphatase CPPED1 | -1.43 | PVX_003585_repetitive organellar protein |
| DEN1 | EKNET | SEQ 1040 | 206 | -1.17 | -1.55 | PF3D7_1430400_autophagy protein 5 | -0.88 | PVX_089085_protein KRI1 |
| DEN1 | NRGPS | SEQ 1041 | 294 | -1.46 | | | -1.86 | PVX_157260_unspecified |
| DEN1 | VKEKE | SEQ 1042 | 339 | -1.11 | -1.12 | PF3D7_0500800_mature parasite-infected erythrocyte surface antigen (MESA) | -0.66 | PVX_123025_selenoprotein |
| DEN1 | KEKEE | SEQ 1043 | 340 | -1.16 | -0.47 | PF3D7_1440200_stromal-processing peptidase | -1.29 | PVX_104695_unspecified |
| DEN1 | EKEEN | SEQ 1044 | 341 | -1.16 | -1.66 | PF3D7_0500800_mature parasite-infected erythrocyte surface antigen (MESA) | -0.70 | PVX_238290_unspecified |
| DEN2 | FQPES | SEQ 1045 | 35 | -1.71 | -0.42 | PF3D7_0720800_Ham1-like protein | -1.36 | PVX_098620_hypothetical protein |
| DEN2 | PESPS | SEQ 1046 | 37 | -1.93 | -2.20 | PF3D7_0808700_erythrocyte membrane protein 1 | -1.66 | PVX_097815_trafficking protein particle complex subunit 8 |
| DEN2 | ESPSK | SEQ 1047 | 38 | -1.67 | | | -1.89 | PVX_135260_unspecified |
| DEN2 | SPSKL | SEQ 1048 | 39 | -1.50 | -1.75 | PF3D7_1442700_conserved *Plasmodium* protein | 0.12 | PVX_084521_ABC transporter B family member 7 |

TABLE 23-continued

| Virus | BEPIpenta | | Pos in NS1 | BEPI (virus) | *P. falciparum* BEPI (standard uTOPE) | gi: curation | P_vivax BEPI (standard uTOPE) | gi: curation (P_vivax) |
|---|---|---|---|---|---|---|---|---|
| DEN2 | GKRSL | SEQ 1049 | 101 | −1.04 | −1.28 | PF3D7_0905300_dynein heavy chain | −0.24 | PVX_119465_T-complex protein 1 subunit beta |
| DEN2 | STESH | SEQ 1050 | 126 | −1.15 | −1.53 | PF3D7_0206000_DNA repair protein RAD2 | −1.55 | PVX_101435_DNA repair protein rhp16 |
| DEN2 | TESHN | SEQ 1051 | 127 | −1.03 | −1.04 | PF3D7_0425800_erythrocyte membrane protein 1 | | |
| DEN2 | PETAE | SEQ 1052 | 139 | −1.23 | −1.65 | PF3D7_1100200_erythrocyte membrane | −0.42 | PVX_123175_hypothetical protein protein 1 |
| DEN2 | PNTNR | SEQ 1053 | 145 | −1.08 | −0.80 | PF3D7_0410000_erythrocyte vesicle protein 1 (EVP1) | −1.36 | PVX_123240_DEAD_DEAH box helicase |
| DEN2 | NRGPS | SEQ 1054 | 294 | −1.66 | | | −1.86 | PVX_157260_unspecified |
| DEN2 | TTTAS | SEQ 1055 | 301 | −1.43 | −1.28 | PF3D7_0716800_eukaryotic translation initiation factor 3 subunit I | −1.12 | PVX_049690_unspecified |
| DEN2 | TTASG | SEQ 1056 | 302 | −1.24 | −1.73 | PF3D7_0712900_erythrocyte membrane protein 1 | −1.87 | PVX_113460_DNA repair protein RAD50 |
| DEN2 | TASGK | SEQ 1057 | 303 | −1.05 | −1.72 | PF3D7_0712900_erythrocyte membrane protein 1 | −0.62 | PVX_118455_clathrin coat assembly protein AP50 |

Example 14: Correlation of Malaria B Cell Epitopes and Potential Autoimmune Epitopes As we describe Zika virus carries pentamer B cell epitopes which match mimics in the human proteome and which may give rise to some of the adverse autoimmune diseases. Zika epitopes of particular interest in this regard are shown in Table 24; these are examples but should not be considered limiting. Notably we identified Zika B cell epitope matches with *Plasmodium* which overlap these but are displaced by one or more amino acids. This indicates that preexisting *Plasmodium* antibodies may bind Zika virus and create steric hindrance preventing the formation of antibodies to the adverse autoimmune epitopes. This is one mechanism by which *Plasmodium* antibodies may provide not only protection against Zika infection but also protect a patient against severe Zika associated autoimmune disease.

TABLE 24

| Zika Pentamer | Human protein containing mimic BEPI | Near Neighbor *Plasmodium falciparum* BEPI | *Plasmodium* Protein |
|---|---|---|---|
| Envelope | | | |
| PRAEA | Platelet derived growth factor receptor, optineurin | RAEAT (SEQ ID NO: 718) | PF3D7_1430700 product_NADP-specific glutamate dehydrogenase (GDH2) |
| TESTE | Synaptogyrin | TESTE (SEQ ID NO: 383) | PF3D7_1122600 conserved *Plasmodium* protein |
| ESTEN | ProNeuropeptide Y | | |
| STENS | Duffy antigen | STENSK (SEQ ID NO: 1277) | PF3D7_1418100 product_liver specific protein 1 |
| NS1 | | | |
| SLAGP | Platelet glycoprotein 1b | AGPLS (SEQ ID NO: 1278) | PF3D7_1150400 product_erythrocyte membrane protein 1 |

TABLE 24-continued

| Zika Pentamer | Human protein containing mimic BEPI | Near Neighbor *Plasmodium falciparum* BEPI | *Plasmodium* Protein |
|---|---|---|---|
| STTAS | Abnormal spindle protein in microcephaly ASPM | TTASG (SEQ ID NO: 1056) | PF3D7_0712900 product_erythrocyte membrane protein 1 |

Example 15: Selected Malaria Antigens for Cross Protection

Peptides in the Zika envelope and NS1 proteins were identified which had highest probability of eliciting antibodies which provide protection. Where a corresponding high probability *Plasmodium falciparum* B cell epitope was identified, containing the same pentamer, the flanking regions on either side of this in the malaria protein were identified, thus defining a 15-mer with the matching pentamer central to the 15-mer. These *Plasmodium* proteins, and 15-mers defined therein, are identified in Table 25 and define immunogens which could provide protection against Zika if included in a vaccine.

In two cases a hexamer match is identified. The lateral ridge, or DE envelope loop of Zika contains the sequence STENSK (SEQ ID NO.: 1277), which is replicated in *P. falciparum* liver specific protein (PF3D7_1418100 liver specific protein 1). This protein is already under consideration as having potential as a malaria vaccine. A second matching hexamer, KKMTGK (SEQ ID NO.: 1279), is found in another conserved *Plasmodium falciparum* protein (PF3D7_1408700 conserved *Plasmodium* protein); in this case the Zika peptide is in the Domain 1 of the envelope. For these two malaria proteins a 16-mer is defined which provides pentamer flanking regions to the hexamer.

While the focus of this invention is protection against Zika virus and the most serious diseases arising therefrom, it would be possible by using the matching pentamers and the extended peptides that comprise them, to design a vaccine which provides protection against both *Plasmodium* and Zika virus.

TABLE 25

15-mer and 16-mer immunogens from P. falciparum

| BEPI (virus) | BEPI penta | SEQ ID NO: | pentamer position in Pf protein | P_falciparum BEPI (standard uTOPE) | gi: curation | Malaria peptide | SEQ |
|---|---|---|---|---|---|---|---|
| | | | | Zika Envelope protein matches | | | |
| -1.04 | TQGEA | 709 | 988 | -1.74 | PF3D7_1240400 erythrocyte membrane protein 1 | SGEPQTQGEASSPSD | SEQ 1058 |
| -1.21 | DKQSD | 710 | 474 | -1.33 | PF3D7_0930400.2 conserved *Plasmodium* protein | KELNSDKQSDKYISD | SEQ 1059 |
| -0.87 | KKMTG | 1280 | 1817 | -1.54 | PF3D7_1408700 conserved *Plasmodium* protein | DEKKKKMTGKEEQII | SEQ 1060 |
| -1.12 | KMTGK | 712 | 1818 | -1.49 | PF3D7_1408700 conserved *Plasmodium* protein | EKKKKMTGKEEQIIV | SEQ 1061 |
| -2.06 | ETDEN | 370 | 472 | -1.07 | PF3D7_1115400 cysteine proteinase falcipain 3 (FP3) | GYINLETDENGYKKT | SEQ 1062 |
| -1.77 | TDENR | 382 | 1389 | -1.07 | PF3D7_1425600 zinc finger protein | DSSLFTDENREEKKD | SEQ 1063 |

TABLE 25-continued 15-mer and 16-mer immunogens from *P. falciparum*

| BEPI (virus) | BEPI penta | SEQ ID NO: | pentamer position in Pf protein | P_falciparum BEPI (standard uTOPE) | gi: curation | Malaria peptide | SEQ |
|---|---|---|---|---|---|---|---|
| -1.31 | RAEAT | 34 | 270 | -0.91 | PF3D7_1430700 NADP-specific glutamate dehydrogenase (GDH2) | GGSNIRAEATGYGVV | SEQ 1064 |
| -1.76 | ADTGT | 365 | 797 | -1.67 | PF3D7_1255200 erythrocyte membrane protein 1 | RPTQDADTGTDDIDD | SEQ 1065 |
| -1.47 | KGRLS | 7 | 522 | -1.20 | PF3D7_0818900 heat shock protein 70 (HSP70) | TITNDKGRLSQDEID | SEQ 1066 |
| -1.38 | GRLSS | 1281 | 965 | -0.92 | PF3D7_1148000 serine_threonine protein kinase | ELSGEGRLSSTGMYK | SEQ 1067 |
| -1.53 | AGTDG | 32 | 557 | -1.69 | PF3D7_1035200 S-antigen | EDKGGAGTDGELSHN | SEQ 1068 |
| -1.45 | TDGPC | 778 | 829 | -1.45 | PF3D7_1300300 erythrocyte membrane protein 1 | SRGTPTDGPCEGKGD | SEQ 1069 |
| -1.19 | DGPCK | 729 | 1376 | -1.16 | PF3D7_0712900 erythrocyte membrane protein 1 | LERLKDGPCKNDSEE | SEQ 1070 |
| -1.62 | TESTE | 731 | 1560 | -1.93 | PF3D7_1122600 conserved *Plasmodium* protein | DTRDKTESTENKVLS | SEQ 1071 |
| -1.51 | ESTEN | 732 | 493 | -0.98 | PF3D7_0205300 conserved *Plasmodium* protein | DELIEESTENLNSQH | SEQ 1072 |
| -1.30 | STENS | 733 | 1022 | -1.03 | PF3D7_1418100 liver specific protein 1 | TNIEWSTENSKTNTT | SEQ 1073 |
| -1.05 | TENSK | 734 | 1023 | -1.27 | PF3D7_1418100 liver specific protein 1 | NIEWSTENSKTNTTN | SEQ 1074 |
| -0.63 | ENSKM | 1282 | 182 | -1.01 | PF3D7_0112000 TatD-like deoxyribonuclease | KNEQVENSKMENGNK | SEQ 1075 |
| | | | | | Zika NS1 protein matches | | |
| -1.13 | SKKET | 739 | 209 | -1.61 | PF3D7_1401200 *Plasmodium* exported protein | FKGLSSKKETEEYVS | SEQ 1076 |
| -1.43 | KKETR | 740 | 1388 | -1.07 | PF3D7_1138400 guanylyl cyclase (GCalpha) | ICKGIEKKETRRWKR | SEQ 1077 |
| -1.43 | YHPDS | 741 | 140 | -1.46 | PF3D7_0823800 DnaJ protein | DLSKQYHPDSNKNCK | SEQ 1078 |
| -1.09 | KTNNS | 745 | 465 | -2.07 | PF3D7_0202000 knob-associated histidine-rich protein (KAHRP) | NKNKEKTNNSKSDGS | SEQ 1079 |
| -1.13 | KGKEA | 746 | 177 | -1.62 | PF3D7_0221700 *Plasmodium* exported protein | RETYDKGKEAKSKRS | SEQ 1080 |
| -0.78 | ESEKN | 1283 | 816 | -1.14 | PF3D7_1018200 serine_threonine protein phosphatase 8 | YAACDESEKNVEEHP | SEQ 1081 |
| -1.07 | SEKND | 747 | 533 | -1.62 | PF3D7_0613900 myosin E | FENEKSEKNDNYINV | SEQ 1082 |
| -1.23 | EKNDT | 748 | 758 | -1.00 | PF3D7_1428400 WD and tetratricopeptide repeats protein 1 | NKKNIEKNDTCNNNN | SEQ 1083 |
| -1.22 | NTREG | 749 | 243 | -1.25 | PF3D7_1332000 syntaxin | IDISLTNTREGQNYL | SEQ 1084 |
| -0.57 | RTQMK | 1284 | 939 | -0.92 | PF3D7_1206200 eukaryotic translation initiation factor 3 sub-unit C | FMQERRTQMKEEKSN | SEQ 1085 |
| -0.42 | TQMKG | 1285 | 244 | -1.04 | PF3D7_0404800 conserved *Plasmodium* protein | KQNNNTQMKGKQNNN | SEQ 1086 |
| -0.53 | QMKGP | 1286 | 479 | -1.40 | PF3D7_1230700 protein transport protein SEC13 (SEC13) | NNNTNQMKGPPGQMN | SEQ 1087 |

TABLE 25-continued 15-mer and 16-mer immunogens from *P. falciparum*

| BEPI (virus) | BEPI penta | SEQ ID NO: | pentamer position in Pf protein | P_falciparum BEPI (standard uTOPE) | gi: curation | Malaria peptide | SEQ |
|---|---|---|---|---|---|---|---|
| -1.45 | TTASG | 754 | 1887 | -1.73 | PF3D7_0712900 erythrocyte membrane protein 1 | PSGNNTTASGKNTPS | SEQ 1088 |
| -1.59 | RPRKE | 756 | 565 | -1.10 | PF3D7_0935400 gametocyte development protein 1 (GDV1) | DIIYKIRPRKENKNV | SEQ 1089 |
| -1.73 | KEPES | 757 | 818 | -1.46 | PF3D7_1030100 pre-mRNA-splicing factor ATP-dependent RNA helicase PRP22 | EILHSKEPESDYVEA | SEQ 1090 |
| -1.52 | EPESN | 758 | 36 | -1.10 | PF3D7_1001900 *Plasmodium* exported protein (hyp16) | SSSKMEPESNRYIKG | SEQ 1091 |
| 16 mer peptides from envelope | | | | | | | |
| | STENSK | 1277 | 1022 | | PFS3D7_1418100 liver specific protein 1 | TNIEWSTENSKTNTTN | SEQ 1092 |
| | KKMTGK | | 1817 | | PF3D7_1408700 conserved *Plasmodium* protein | DEKKKKMTGKEEQIIV | SEQ 1093 |

Analysis of *P falciparum* and *P vivax* was initially carried out using the well characterized type strains 3D7 and Sal1 respectively. In order to evaluate whether the same B cell epitopes are consistently present in wild type *Plasmodium* strains and therefore whether natural infection would offer the same protection against Zika infection we searched for the presence of the two hexamers. Both STENSK (SEQ ID NO.: 1277) and KKMTGK (SEQ ID NO.: 1279) are conserved in 16 isolates of *P. falciparum* examined from diverse different geographical sources.

Immunogen polypeptides were prepared based on the P PF3D7_1418100 liver specific protein 1 peptide shown as SEQ 1092 above. In one instance the peptide was flanked by adjoining wildtype sequences to provide a 70 amino acid polypeptide to which an additional cysteine was added. In a second instance a T cell epitope from ZIKV was inserted into the C terminal flank of STENSK (SEQ ID NO.: 1277). In some embodiments, His tags were added to N or C terminal of the *Plasmodium* polypeptide to facilitate purification. The rationale was to provide both B cell and T helper motifs which would be present in a wild type ZIKV challenge while not creating the same mimics present in ZIKV. The resultant Sequences are shown below. These were then expressed by stable transfection into CHO cells as previously described.

Seq.1094.*P. falciparum* LISP, Nucleotide Sequence
1-63 Signal peptide
70-252 falciparum LISP Seq.1095. *P. falciparum* LISP, Amino Acid Sequence
1-21 Signal peptide
24-84 falciparum LISP Seq.1096. 6×His-*P. falciparum* LISP, Nucleotide Sequence
1-63 Signal peptide
70-87 6× Histag
88-270 falciparum LISP Seq.1097. 6×His-*P. falciparum* LISP, Amino Acid Sequence
1-21 Signal peptide
24-29 6× Histag
30-90 falciparum LISP Seq.1098. *P. falciparum* LISP-6×His, Nucleotide Sequence
1-63 Signal peptide
70-252 falciparum LISP
253-270 6× Histag Seq.1099. *P. falciparum* LISP-6×His, Amino Acid Sequence
1-20 Signal peptide
21-131 Light chain variable region Seq.1100. *P. falciparum* LISP with ZV Tcell Epitope, Nucleotide Sequence
1-63 Signal peptide
70-282 falciparum LISP with ZV T cell epitope Seq.1101. *P. falciparum* LISP with ZV Tcell Epitope, Amino Acid Sequence
1-21 Signal peptide
22-94 falciparum LISP with ZV T cell epitope Seq.1102. 6×His-*P. falciparum* LISP with ZV Tcell Epitope, Nucleotide Sequence
1-63 Signal peptide
70-87 6× Histag
88-300 falciparum LISP with ZV T cell epitope Seq.1103. 6×His-*P. falciparum* LISP with ZV Tcell Epitope, Amino Acid Sequence
1-21 Signal peptide
24-29 6× Histag
30-100 falciparum LISP with ZV T cell epitope Seq.1104. *P. falciparum* LISP with ZV Tcell Epitope-6× His, Nucleotide Sequence, ID:500n
1-63 Signal peptide
70-282 falciparum LISP with ZV T cell epitope
283-300 6× Histag Seq.1105. *P. falciparum* LISP with ZV Tcell Epitope-6× His, Amino Acid Sequence
1-21 Signal peptide
22-94 falciparum LISP with ZV T cell epitope
95-100 6× Histag

Example 16. Epitope Mimics in NS1 Corresponding to Cardiovascular Function Human Proteins Epitope analysis of NS1 was conducted for an array of flaviviruses including four serotypes of dengue, yellow fever, Zika virus and Usutu virus, as well as St Louis encephalitis, West Nile, Japanese encephalitis, and Tick borne encephalitis. This included evaluation of the following criteria Table 26 and a matrix database for these parameters applied to each successive peptide was created. FIG. 31 shows a summary comparative depiction of the immunomic features of each.

TABLE 26

| Immunological Metric | Method | Prediction |
|---|---|---|
| MHC I affinity 9-mer | Neural Network Ensembles trained on binding data sliding window of 9-aa indexed by 1 amino acid<br>20 HLA-A<br>17 HLA-B<br>6 murine | LN ($IC_{50}$)<br>std dev LN($IC_{50}$) (ave = 0.5 LN ($IC_{50}$))<br>standardized affinity within protein or proteome (enables using additivity of variance)<br>relative binding probability thresholds for each peptide |
| MHC II affinity 15-mer | Neural Network Ensembles trained on binding data sliding window of 15-amino acids indexed by 1 amino acid<br>16 DR<br>6 DP<br>6DQ | LN ($IC_{50}$)<br>std dev LN($IC_{50}$) (ave = 0.5-0.7 LN ($IC_{50}$))<br>standardized affinity within protein or proteome (enables using additivity of variance)<br>relative binding probability thresholds for each peptide |
| MHC + MHC II cross presentation | MHC I + MHC II simultaneous binding to peptides in a protein | Number of high affinity MHC I 9-mers within each high affinity MHC II 15-mer |
| Linear B-cell epitope 8-mer | Neural network trained on B-cell epitopes<br>Sliding window of 8 amino acids indexed by 1 aa | probability of B cell binding standardized within protein<br>relative probability among peptides |
| Cathepsin cleavage Human cathepsin B, L and S | Neural Network Ensembles trained on large proteomic cleavage database mass spectrometry of cleaved peptides for the enzymes. | Two independent predictions<br>probability of cleavage + probability of non-cleavage between aa4 and aa5 (P1P1') of an octomer |
| Combined cathepsin cleavage + MHC I + MHC II binding affinity | Combination of 3 prediction method outputs | Probability of excision of various length peptides between 15-21 amino acids in length for MHC II and exactly 9 amino acids. |
| T-cell exposed motif (TCEM) relative to normal human repertoires | Frequency comparison to database for:<br>continuous pentamer within a bound MHC I 9-mer<br>two discontinuous pentamers (9-mer core of a bound MHC II 15-mer) | Specific motifs exposed to T cell by peptide bound in MHC<br>Frequency relative to IGHV germline and somatic mutation<br>Frequency relative to human proteome<br>Frequency relative to GI microbiome |
| Combination of MHC I and MHC II binding by allele in combination with TCEM T-cell exposure and cathepsin cleavage | Graphical/interactive combination of 5 different prediction outputs | Interactive graphical platform for evaluation Treg potential based on combination of:<br>binding predictions and<br>TCEM frequency data using additivity of variance |
| Mimicry of B-cell receptors (immunoglobulins) | Pentamer (core of 9-mer BEPI prediction) exposure comparison between proteins of interest (e.g. viral protein vs multiple isoforms of all proteins in human proteome) in combination with MHC binding predictions | Proximity of MHC binding regions to BEPIs<br>Pentamer matches (random probability of match = $20^{-10}$)<br>BEPI probability classification matches between selected proteins<br>UniProt keyword screens<br>URL connection to internet resources |
| Protein topology | Neural Network Ensembles<br>Slider, graphical interface compared to Web references | Amino acids of protein comprising extra-cellular domain<br>Amino acids of protein comprising intra-cellular domains<br>Amino acids of protein comprising trans-membrane domains<br>Signal peptides cleavage point |

Particular attention was focused on the C terminal loop of NS1 lying between amino acids 280 and 329, bounded by cysteine residues, and more particularly between 290 and 311, likewise bounded by cysteine residues. This region contains not only strong predicted B cell epitope but also a region of high WIC II binding for multiple alleles as shown in FIG. 31 and FIG. 32 and in Table 27 below.

TABLE 27

| Predicted MHC II binding of sequential peptides across NS1 280-329 for multiple flaviviruses. Prediction is the permuted population average across 28 alleles of MHC II | | | | | | | | |
|---|---|---|---|---|---|---|---|---|
| Index amino | Permuted average MHC II binding across 28 MHC II alleles | | | | | | | |
| acid Position# | DEN1 | DEN2 | DEN3 | DEN4 | YF | WNV | ZIKV | USUV |
| 280 | −0.55 | −0.76 | −0.74 | −0.05 | −0.56 | −1.14 | −0.60 | −1.25 |
| 281 | −0.38 | −0.40 | −0.67 | 0.05 | −0.51 | −0.90 | −0.74 | −1.02 |
| 282 | −0.11 | 0.05 | −0.63 | 0.10 | −0.39 | −0.44 | −0.78 | −0.71 |
| 283 | 0.10 | 0.40 | −0.55 | −0.04 | −0.31 | −0.04 | −0.71 | −0.49 |
| 284 | 0.06 | 0.43 | −0.55 | −0.28 | −0.32 | 0.04 | −0.75 | −0.44 |
| 285 | −0.17 | 0.28 | −0.57 | −0.39 | −0.27 | −0.08 | −0.74 | −0.50 |
| 286 | −0.39 | 0.16 | −0.63 | −0.36 | −0.13 | −0.04 | −0.80 | −0.52 |
| 287 | −0.39 | 0.19 | −0.58 | −0.40 | 0.16 | 0.05 | −0.73 | −0.44 |
| 288 | −0.31 | 0.19 | −0.44 | −0.42 | 0.54 | 0.29 | −0.59 | −0.34 |
| 289 | −0.38 | 0.04 | −0.33 | −0.47 | 0.85 | 0.41 | −0.52 | −0.31 |
| 290 | −0.52 | −0.24 | −0.36 | −0.56 | 0.98 | 0.35 | −0.52 | −0.40 |
| 291 | −0.69 | −0.56 | −0.54 | −0.67 | 1.01 | 0.17 | −0.58 | −0.54 |
| 292 | −0.84 | −0.82 | −0.77 | −0.76 | 0.89 | −0.09 | −0.65 | −0.66 |
| 293 | −0.88 | −0.84 | −0.82 | −0.81 | 0.79 | −0.26 | −0.59 | −0.64 |
| 294 | −0.88 | −0.87 | −0.83 | −0.83 | 0.52 | −0.34 | −0.59 | −0.66 |
| 295 | −0.91 | −0.86 | −0.84 | −0.83 | 0.19 | −0.38 | −0.61 | −0.68 |
| 296 | −0.95 | −0.88 | −0.86 | −0.85 | −0.11 | −0.49 | −0.61 | −0.70 |
| 297 | −0.98 | −0.84 | −0.87 | −0.84 | −0.17 | −0.52 | −0.62 | −0.69 |
| 298 | −1.02 | −0.87 | −0.90 | −0.86 | −0.22 | −0.56 | −0.57 | −0.71 |
| 299 | −1.03 | −0.93 | −0.94 | −0.83 | −0.36 | −0.64 | −0.57 | −0.76 |
| 300 | −1.10 | −1.02 | −1.02 | −0.88 | −0.73 | −0.84 | −0.67 | −0.82 |
| 301 | −1.25 | −1.16 | −1.17 | −1.03 | −1.09 | −1.08 | −0.84 | −0.93 |
| 302 | −1.36 | −1.17 | −1.29 | −1.10 | −1.24 | −1.14 | −0.94 | −0.88 |
| 303 | −1.43 | −1.21 | −1.36 | −1.19 | −1.26 | −1.19 | −1.05 | −0.93 |
| 304 | −1.59 | −1.47 | −1.52 | −1.43 | −1.40 | −1.48 | −1.21 | −1.27 |
| 305 | −1.81 | −1.81 | −1.73 | −1.70 | −1.58 | −1.88 | −1.50 | −1.73 |
| 306 | −2.03 | −2.13 | −1.96 | −2.01 | −1.77 | −2.26 | −1.76 | −2.14 |
| 307 | −2.14 | −2.25 | −2.09 | −2.13 | −1.82 | −2.42 | −1.86 | −2.31 |
| 308 | −2.12 | −2.19 | −2.08 | −2.07 | −1.77 | −2.36 | −1.85 | −2.22 |
| 309 | −2.11 | −2.20 | −2.05 | −2.07 | −1.77 | −2.33 | −1.91 | −2.22 |
| 310 | −2.11 | −2.19 | −2.04 | −2.08 | −1.74 | −2.33 | −1.97 | −2.22 |
| 311 | −2.11 | −2.20 | −2.06 | −2.13 | −1.77 | −2.36 | −2.04 | −2.26 |
| 312 | −2.15 | −2.23 | −2.12 | −2.19 | −1.78 | −2.44 | −2.08 | −2.34 |
| 313 | −2.06 | −2.10 | −2.04 | −2.14 | −1.62 | −2.35 | −1.98 | −2.26 |
| 314 | −1.88 | −1.85 | −1.83 | −2.05 | −1.38 | −2.10 | −1.83 | −2.06 |
| 315 | −1.67 | −1.57 | −1.59 | −1.95 | −1.16 | −1.80 | −1.66 | −1.80 |
| 316 | −1.56 | −1.40 | −1.47 | −1.93 | −1.13 | −1.62 | −1.62 | −1.65 |
| 317 | −1.56 | −1.40 | −1.49 | −1.99 | −1.26 | −1.62 | −1.65 | −1.66 |
| 318 | −1.57 | −1.44 | −1.55 | −1.99 | −1.38 | −1.69 | −1.63 | −1.72 |
| 319 | −1.49 | −1.36 | −1.49 | −1.93 | −1.32 | −1.63 | −1.51 | −1.63 |
| 320 | −1.44 | −1.33 | −1.49 | −1.91 | −1.32 | −1.57 | −1.45 | −1.64 |
| 321 | −1.48 | −1.42 | −1.54 | −1.89 | −1.46 | −1.58 | −1.51 | −1.79 |
| 322 | −1.53 | −1.56 | −1.58 | −1.86 | −1.70 | −1.62 | −1.64 | −1.99 |
| 323 | −1.50 | −1.64 | −1.56 | −1.76 | −1.87 | −1.66 | −1.70 | −2.11 |
| 324 | −1.45 | −1.65 | −1.52 | −1.68 | −1.92 | −1.67 | −1.70 | −2.12 |
| 325 | −1.38 | −1.61 | −1.49 | −1.66 | −1.84 | −1.61 | −1.65 | −2.05 |
| 326 | −1.37 | −1.61 | −1.53 | −1.70 | −1.84 | −1.60 | −1.64 | −2.08 |
| 327 | −1.39 | −1.64 | −1.55 | −1.73 | −1.82 | −1.61 | −1.62 | −2.08 |
| 328 | −1.43 | −1.67 | −1.59 | −1.77 | −1.84 | −1.63 | −1.65 | −2.15 |
| 329 | −1.43 | −1.66 | −1.58 | −1.76 | −1.87 | −1.64 | −1.67 | −2.13 |

Analysis was then conducted of NS1 of the same set of flaviviruses in order to compare predicted B cell linear epitopes to the predicted B cell linear epitopes in the proteins of the human proteome which have a function related to cardiovascular function. Human proteins were selected for inclusion in this comparison if they were annotated in UniProt with one of the key words shown in Table 28.

TABLE 28

| Cardiovascular key words |
|---|
| acetyl-transferring |
| alpha-2-antiplasmin |
| alpha-hemoglobin-stabilizing |
| angio-associated |
| angiogenesis |

TABLE 28-continued

| Cardiovascular key words |
|---|
| angiogenic |
| angiogenin |
| angiomotin |
| angiomotin-like |
| angiopoietin-1 |
| angiopoietin-2 |
| angiopoietin-4 |
| angiopoietin-like |
| angiopoietin-related |
| angiostatin |
| angiotensin |
| angiotensin-converting |
| angiotensinogen |
| antigen_chemokine |

TABLE 28-continued

| Cardiovascular key words |
|---|
| antithrombin-iii |
| ceruloplasmin |
| chemokine |
| chemokine-like |
| chemokine-related |
| chemotactic |
| chemotaxin |
| chemotaxin-2 |
| chemotaxis |
| coagulation |
| c-reactive |
| cyclotransferase |
| cyclotransferase-like |
| desmoplakin |
| endoplasmic |
| endoplasmin |
| endoplasmin-like |
| endothelial |
| endothelin |
| endothelin-1 |
| endothelin-2 |
| endothelin-3 |
| endothelin-converting |
| envoplakin |
| envoplakin-like |
| epiplakin |
| erythroblast |
| erythrocyte |
| erythroid |
| erythropoietic |
| erythropoietin |
| ferredoxin |
| ferredoxin-fold |
| ferric-chelate |
| ferritin |
| ferrochelatase |
| fibrillarin |
| fibrillarin-like |
| fibrillary |
| fibrillin-1 |
| fibrillin-2 |
| fibrillin-3 |
| fibrinogen |
| fibrinogen-like |
| gamma-glutamylcyclotransferase |
| hematological |
| hematopoietic |
| hematopoietically-expressed |
| heme |
| heme-binding |
| hemochromatosis |
| hemofiltrate |
| hemogen |
| hemoglobin |
| hemojuvelin |
| hemopexin |
| lactotransferrin |
| lipoma-preferred |
| lvv-hemorphin-7 |
| melanotransferrin |
| microfibril-associated |
| microfibrillar-associated |
| mitoferrin-1 |
| mitoferrin-2 |
| neuferricin |
| nucleoplasmin-2 |
| nucleoplasmin-3 |
| periplakin |
| plakoglobin |
| plakophilin-1 |
| plakophilin-2 |
| plakophilin-3 |
| plakophilin-4 |
| plasminogen |
| plasminogen-like |
| platelet |

TABLE 28-continued

| Cardiovascular key words |
|---|
| platelet-activating |
| platelet-derived |
| prothrombin |
| protoheme |
| sarcoplasmic_endoplasmic |
| serotransferrin |
| thrombomodulin |
| thrombopoietin |
| thrombospondin |
| thrombospondin-1 |
| thrombospondin-2 |
| thrombospondin-3 |
| thrombospondin-4 |
| thrombospondin-type |
| thromboxane |
| thromboxane-a |
| transferrin |
| uroplakin-1a |
| uroplakin-1b |
| uroplakin-2 |
| uroplakin-3a |
| uroplakin-3b |
| uroplakin-3b-like |
| vascular |
| vasculin |
| vasculin-like |
| vasoactive |
| vasodilator-stimulated |
| vasohibin-1 |
| vasohibin-2 |
| vasopressin |
| vasopressin-induced |
| vasopressin-neurophysin |
| vasorin |
| vwf |
| vwfa |
| willebrand |
| williams-beuren |

Peptide pentamer motifs were identified in flaviviruses which matched pentamer motifs in the cardiovascular protein set, where in both cases the pentamer occurred in a predicted linear B cell epitope. The resulting list was manually curated to exclude proteins which contained terms such as “domain containing” and to identify the proteins actually verified as related to or expressed in blood coagulation, platelets, endothelial cells and erythrocytes.

Accession numbers of viruses used in identifying these were as shown in Table 29. Additional strains/isolates of all were used to evaluate conservation. Table 30 shows peptides found in dengue, Zika, and Usutu virus NS1 which have mimics in the human cardiovascular set proteins and which fulfill the B cell epitope criteria.

TABLE 29

| Accession numbers of viruses analyzed | | | | | |
|---|---|---|---|---|---|
| Flavivirus | | Polyprotein gi | Polyprotein accession | Nucleotide gi | DBSource accession |
| Zika | Brazil SPH2015 | 969945757 | ALU33341.1 | 969945756 | KU321639.1 |
| Zika | Senegal ArD158084 | 592746966 | AHL43504.1 | 592746965 | KF383119.1 |
| Dengue 1 | Nauru/West Pac/1974 | 1854039 | AAB70695.1 | 1854038 | U88536.1 |
| Dengue 1 | Brazil 12898/BR-PE/10 | 511782627 | AGN94866.1 | 5117826276 | JX669462.1 |
| Dengue 2 | Thailand/16681/84 | 323473 | AAA73185.1 | 323472 | M84727.1 |
| Dengue 2 | Brazil 9479/BR-PE/10 | 511782661 | AGN94883.1 | 511782660 | JX669479.1 |
| Dengue 3 | Philippines 1956/H87 | 961377532 | ALS05358.1 | 961377531 | KU050695.1 |
| Dengue 3 | Brazil 2009 D3BR/AL95/2009 | 389565793 | AFK83755.1 | 389565792 | JF808120.1 |
| Dengue 4 | Thailand/0476/1997 | 53653743 | AAU89375.1 | 53653742 | AY618988.1 |
| Dengue 4 | Brazil DENV-4/BEL83791 | 418715828 | AFX65871.1 | 418715827 | JQ513335.1 |
| Yellow fever | Live Attenuated Yellow Fever Vaccine 17D-204 | 564014615 | AHB63684.1 | 564014614 | KF769015.1 |
| Yellow fever | Peru 2007 “case #2” | 256274854 | ACU68590.1 | 256274853 | GQ379163.1 |
| West Nile | West Nile Virus 04-216CO | 90025138 | ABD85073.1 | 90025137 | DQ431702.1 |
| Japanese encephalitis | JEV SA-14 | 331332 | AAA46248.1 | 331331 | M55506.1 |
| Tick-borne encephalitis | TBEV Neudoerfl | 975238 | AAA86870.1 | 975237 | U27495.1 |
| Usutu | Usutu virus strain Italia 2009 | 339831600 | AEK21245.1 | 339831599 | JF266698 |

TABLE 30

| Epitope mimics in NS1 proteins | | | | | |
|---|---|---|---|---|---|
| Virus | Human protein annotation (short) | Virus B cell probability## | Proteome B cell probability## | query penta | SEQ ID NO: |
| DEN1 | A disintegrin and metalloproteinase with thrombospondin motifs 13 ADAMTS13 | −1.12 | −0.23 | SLRTT | SEQ 1106 |
| DEN2 | A disintegrin and metalloproteinase with thrombospondin motifs 13 ADAMTS13 | −1.45 | −0.23 | SLRTT | SEQ 1106 |
| DEN3 | A disintegrin and metalloproteinase with thrombospondin motifs 13 ADAMTS13 | −1.19 | −0.23 | SLRTT | SEQ 1106 |
| DEN4 | A disintegrin and metalloproteinase with thrombospondin motifs 13 ADAMTS13 | −1.34 | −0.23 | SLRTT | SEQ 1106 |
| DEN3 | Coagulation factor V | −0.26 | −1.01 | ASRAW | SEQ 1107 |
| DEN3 | Coagulation factor VIII | −0.72 | −0.25 | IDGPS | SEQ 1108 |
| DEN4 | Coagulation factor VIII | −0.50 | −0.57 | KGKRA | SEQ 1109 |
| DEN4 | Plasminogen | −1.09 | −0.21 | IFTPE | SEQ 1110 |
| DEN1 | Plasminogen | −0.94 | −1.03 | TTVTG | SEQ 1111 |
| DEN3 | Platelet glycoprotein Ib beta chain | −0.84 | −1.34 | SLAGP | SEQ 1112 |
| ZIKV | Platelet glycoprotein Ib beta chain | −0.79 | −1.34 | SLAGP | SEQ 1118 |
| DEN3 | Vascular endothelial growth factor A | −0.62 | −1.19 | SASRA | SEQ 1113 |
| ZIKV | Vascular endothelial growth factor B | −1.51 | −1.64 | PDSPR | SEQ 1114 |
| DEN2 | Vascular endothelial growth factor receptor 1 | −0.67 | −0.80 | AGKRS | SEQ 1115 |
| DEN3 | Vascular endothelial growth factor receptor 1 | −0.58 | −1.06 | LEQGK | SEQ 1116 |
| DEN4 | Vascular endothelial growth factor receptor 2 | −0.52 | −0.43 | KNSTF | SEQ 1117 |
| ZIKV | von Willebrand factor | −0.53 | −0.97 | EECPG | SEQ 1119 |
| ZIKV | von Willebrand factor | −0.86 | −0.15 | EETCG | SEQ 1120 |
| ZIKV | von Willebrand factor | −0.64 | −0.46 | VEETC | SEQ 1121 |
| USUV | Platelet endothelial aggregation receptor 1 | −0.93 | −0.98 | SSGRL | SEQ 1122 |
| USUV | Platelet glycoprotein Ib beta chain | −1.01 | −1.72 | LAGPR | SEQ 1123 |

B cell probabilities are shown in inverse standard deviation units. More negative scores are more likely B cell epitopes in the corresponding protein.

Some of these mimics may vary depending on the strain of dengue virus, and it will be clear to those skilled in the art that adjustments may be needed on a geographic basis or over time to adapt to changes in mimics which may affect clinical outcome. However, in particular it was noted that all dengue viruses contained a conserved motif SLRTT located in the stable C terminal loop of NS1 between two cysteine bonds [61] at positions 290-311 of the NS1 protein which corresponds to a motif in the C terminal region of ADAMTS13. ADAMTS13 is expressed in endothelial cells and is essential to cleavage to von Willebrand factor. A deficiency of ADAMTS13 is associated with accumulation of multimers of von Willebrand factor, intravascular platelet aggregation, and thrombocytopenia, both congenital and acquired [70, 71]. ADAMTS is expressed in endothelial cells. Other motifs were found in coagulation factors V and VIII, von Willebrand factor and in platelet glycoprotein 1B beta which is also associated with acquired autoimmune thrombocytopenia [72] and is expressed in both platelets and endothelial cells. Notably these epitope mimic motifs for cardiovascular function proteins are not present in West Nile virus.

Development of transient autoimmunity to these motifs may arise on initial dengue infection but be exacerbated on re-exposure to a further dengue serotype, potentially further boosted by antibody dependent enhancement, thereby contributing to hemorrhagic signs characteristic of dengue hemorrhagic fever. It would be beneficial to remove such epitopes in a vaccine containing NS1 to preclude sensitization to an anamnestic autoimmune response on exposure to wildtype virus of any of the dengue serotypes.

NS1 Vaccine Constructs with Mimics Removed

Vaccines may be designed to elicit an immune response to other epitopes but avoid an immune response to epitopes which may elicit an autoimmune response. Examples of such constructs are shown below, however it should be appreciated that these are examples which are not limiting. Vaccines may comprise synthetic polypeptides alone or as fusions to an immunoglobulin or other fusion protein and may be operatively linked by various linkers including an enterokinase linker as shown here. In the case of dengue, we show an illustrative example for dengue serotype 2 native protein construct followed by a mimic, however following a similar logic, analogous NS1 sequences may be made for other serotypes in which the principal mimic epitopes are removed. In reviewing Usutu virus it was also noted that the motif TTTSS (SEQ ID NO.: 1125) generates a high probability mimic matching human myeloid differentiation factor and RTTTS (SEQ ID NO.: 1124) matching Synaptopodin 2 (Table 31) these were also removed. The mutant sequences were reviewed to ensure that no new adverse mimics were created.

TABLE 31

Neurologic function mimics in Usutu NS1

| | | | | | |
|---|---|---|---|---|---|
| USUV | Synaptopodin 2 | −1.88 | −0.5 | RTTTS | SEQ 1124 |
| USUV | Myeloid differentiation factor | −1.82 | −2.14 | TTTSS | SEQ 1125 |

Seq.1126. DEN2_NS1 SA, Nucleotide Sequence
7-81 Signal peptide
82-1134 DEN2-NS1 from POLG DEN26
Seq.1127. DEN2_NS1 SA, Amino Acid Sequence
3-27 Signal peptide
28-378 DEN2-NS1 from POLG DEN26
Seq.1128. ZIKV-NS1 SA, Nucleotide Sequence
7-78 Signal peptide
79-1134 ZIKV-NS1 from SPH2015
Seq.1129. ZIKV-NS1 SA, Amino Acid Sequence
3-26 Signal peptide
27-378 ZIKV-NS1 from SPH2015
Seq.1130. Usutu-NS1 SA, Nucleotide Sequence
7-78 Signal peptide
79-1134 Usutu-NS1
Seq.1131. Usutu-NS1 SA, Amino Acid Sequence
3-26 Signal peptide
27-378 Usutu-NS1
Seq.1132. DEN2_NS1-EKL-hG1(CH2-CH3), Nucleotide Sequence
1-63 Signal peptide
70-1131 DEN2 NS1 from POLG DEN26
1132-1155 Enterokinase Linker
1162-1857 hG1(CH2-CH3) Constant region
Seq.1133. DEN2_NS1-EKL-hG1(CH2-CH3), Amino Acid Sequence
1-21 Signal peptide
24-377 DEN2 NS1 from POLG DEN26
378-385 Enterokinase Linker
388-619 hG1(CH2-CH3) Constant region
Seq.1134. ZIKV_NS1-EKL-hG1(CH2-CH3), Nucleotide Sequence
1-63 Signal peptide
70-1131 ZIKV_NS1 from SPH2015
1132-1155 Enterokinase Linker
1162-1857 hG1(CH2-CH3) Constant region
Seq.1135. ZIKV_NS1-EKL-hG1(CH2-CH3), Amino Acid Sequence
1-21 Signal peptide
24-377 ZIKV_NS1 from SPH2015
378-385 Enterokinase Linker
388-619 hG1(CH2-CH3) Constant region
Seq.1136. Usutu_NS1-EKL-hG1(CH2-CH3), Nucleotide Sequence
1-63 Signal peptide
70-1131 Usutu_NS1
1132-1155 Enterokinase Linker
1162-1857 hG1(CH2-CH3) Constant region
Seq.1137. Usutu_NS1-EKL-hG1(CH2-CH3), Amino Acid Sequence
1-21 Signal peptide
24-377 Usutu_NS1
378-385 Enterokinase Linker
388-619 hG1(CH2-CH3) Constant region

Example 17: NS1 Loops for Diagnostics

The C terminal loop of NS1 proteins of flaviviruses is highly conserved within strains of each virus. In NS1 the peptide sequence lying between cysteines at 290 and 311 is unique to each flavivirus, but highly conserved among strains of that flavivirus. This loop also comprises a strong B cell epitope. In dengue the loop comprises the motif SLRTT (SEQ ID NO.: 1106) which as described above is a mimic for the human protein ADAMTS13. Table 32 shows the alignment for various flaviviruses of interest. By assembling peptides comprising the 290-311 sequence a loop is formed stabilized by the C—C bonds. As seen in Table 32 the loop comprises the sequence CXXRGXXXRXTTXXGRXXXXWC (SEQ ID NO: 1245) in all flavivruses of interest but is unique to each virus of interest. Therefore, an array comprising variations on this generic sequence structure provides a diagnostic array. An array of the 290-311 loops and derivative constructs thereof can thus serve as a differential diagnostic to differentiate antibody responses to the flaviviruses.

The loop thus formed by a C—C bond may be expressed operably associated as a fusion with an indicator label peptide such as GFP or luciferase or other label peptides. In yet other embodiments an adherent tag or anchor peptide such as a histidine tag or a FLAG tag may be expressed as a fusion with the loop. Said label or anchor peptide may be positioned at the N terminus or the C terminus of the loop peptide. In yet further embodiments the loop may be expressed with both indicator and adherent tags simultaneously.

The loop peptides may be utilized in an ELISA, a dot blot, a bead attached peptide or in many other serodiagnostic configurations, so that these examples are not considered limiting. Negative control loop peptides are constructed containing a pentamer "scrambled" motif not present in any flavivirus.

TABLE 32

Comparative amino acid distribution on C terminal loop of NS1

| | YF | DEN1 | DEN2 | DEN3 | DEN4 | ZIKV | WNV | JEV | TBEV | SLE | USUV | scramble |
|---|---|---|---|---|---|---|---|---|---|---|---|---|
| 290 | C | C | C | C | C | C | C | C | C | C | C | C |
| 291 | D | G | G | G | D | G | E | S | D | G | G | G |
| 292 | G | N | N | T | H | T | H | K | K | N | K | T |
| 293 | R | R | R | R | R | R | R | R | R | R | R | R |
| 294 | G | G | G | G | G | G | G | G | G | G | G | G |
| 295 | K | P | P | P | P | P | P | P | A | A | P | P |
| 296 | S | S | S | S | S | S | A | S | S | S | S | S |
| 297 | T | L | L | L | L | L | A | V | V | L | I | L |
| 298 | R | R | R | R | R | R | R | R | R | R | R | R |
| 299 | S | T | T | T | T | S | T | T | S | T | T | M |
| 300 | T | T | T | T | T | T | T | T | T | T | T | T |
| 301 | T | T | T | T | T | T | T | T | T | T | T | T |
| 302 | D | V | A | V | A | A | E | D | E | A | S | V |
| 303 | S | T | S | S | S | S | S | S | S | S | S | M |
| 304 | G | G | G | G | G | G | G | G | G | G | G | G |
| 305 | K | K | K | K | K | R | K | K | K | K | R | R |
| 306 | V | I | L | L | L | V | L | L | V | L | L | V |
| 307 | I | I | I | I | V | I | I | I | I | V | V | I |
| 308 | P | H | T | H | T | E | T | T | P | T | T | E |
| 309 | E | E | E | E | Q | E | D | D | E | D | D | E |
| 310 | W | W | W | W | W | W | W | W | W | W | W | W |
| 311 | C | C | C | C | C | C | C | C | C | C | C | C |

Exemplary sequences are provided below for dengue Zika, Usutu, and West Nile viruses plus a scrambled mimic control. We note that early African Usutu viruses have a sequence CGKRGPSIRTTTNSGRLVTDWC but the 302 N is replaced by a serine in current European sequences and thus this is adopted here for diagnostic purposes.

TABLE 33

| Loop sequences from NS1 of flaviviruses of interest | | |
|---|---|---|
| YF | CDGRGKSTRSTTDSGKVIPEWC | SEQ 1138 |
| DEN1 | CGNRGPSLRTTTVTGKIIHEWC | SEQ 1139 |
| DEN2 | CGNRGPSLRTTTASGKLITEWC | SEQ 1140 |
| DEN3 | CGTRGPSLRTTTVSGKLIHEWC | SEQ 1141 |
| DEN4 | CDHRGPSLRTTTASGKLVTQWC | SEQ 1142 |
| ZIKV | CGTRGPSLRSTTASGRVIEEWC | SEQ 1143 |
| WNV | CEHRGPAARTTTESGKLITDWC | SEQ 1144 |
| JEV | CSKRGPSVRTTTDSGKLITDWC | SEQ 1145 |
| TBEV | CDKRGASVRSTTESGKVIPEWC | SEQ 1146 |
| SLE | CGNRGASLRTTTASGKLVTDWC | SEQ 1147 |

TABLE 33-continued

| Loop sequences from NS1 of flaviviruses of interest | | |
|---|---|---|
| USUV | CGKRGPSIRTTTSSGRLVTDWC | SEQ 1148 |
| Scramble | CGTRGPSLRMTTVMGRVIEEWC | SEQ 1149 |

Exemplary constructs are provided for expression of some the above "loop" diagnostic sequences as synthetic polypeptides with a label sequence at the C terminal end. Those skilled in the art will understand that the label GFP sequences shown could be replaced by other labels or anchor sequences such as a his tag and similarly will understand how to make similar constructs for the other flaviviruses. Further such a skilled artisan will be able to place the label or anchor at the N terminal end of the loop.

Seq. 1150. ZikVLoop-Link-GFP, Nucleotide Sequence
4-69 ZikV Loop Region
76-90 Linker
91-807 GFP Seq.1151. ZikVLoop-Link-GFP, Amino Acid Sequence
2-23 ZikV Loop Region
26-30 Linker
31-269 GFP Seq.1152. ScrambleLoop-Link-GFP, Nucleotide Sequence
4-69 Scramble Loop Region
76-90 Linker
91-807 GFP Seq.1153. ScrambleLoop-Link-GFP, Amino Acid Sequence
2-23 Scramble Loop Region
26-30 Linker
31-269 GFP Seq.1154. YellowFeverLoop-Link-GFP, Nucleotide Sequence
4-69 Yellow Fever Loop Region
76-90 Linker
91-807 GFP Seq.1155. YellowFeverLoop-Link-GFP, Amino Acid Sequence
2-23 Yellow Fever Loop Region
26-30 Linker
31-269 GFP Seq.1156. WestNileLoop-Link-GFP, Nucleotide Sequence
4-69 West Nile Loop Region
76-90 Linker
91-807 GFP Seq.1157. WestNileLoop-Link-GFP, Amino Acid Sequence
2-23 West Nile Loop Region
26-30 Linker
31-269 GFP Seq.1158. Dengue2Loop-Link-GFP, Nucleotide Sequence
4-69 Dengue2 Loop Region
76-90 Linker
91-807 GFP Seq.1159. Dengue2Loop-Link-GFP, Amino Acid Sequence
2-23 Dengue2 Loop Region
26-30 Linker
31-269 GFP Seq.1160. UsutuLoop-Link-GFP, Nucleotide Sequence
4-69 Usutu Loop Region
76-90 Linker
91-807 GFP

Example 18: Epitopes in Usutu Virus Structural Proteins

FIG. 33 shows the predicted epitopes in USUV envelope protein. FIG. 34 shows predicted epitopes in the PrM, FIG. 35 shows the predicted epitopes in Capsid proteins, and FIG. 36 the NS1 protein. These figures are based on recent European isolates, using the Usutu Italian isolate, Accession number JF266698.

Tables 9-11 shows predicted B cell epitope mimics in these structural proteins of USUV for neurologic proteins, microcephaly related proteins and cardiovascular proteins.

TABLE 34

Neurologic protein mimics in USUV structural proteins

| USUV protein<br>Human protein<br>Envelope | SEQ<br>ID NO: | Pentamer<br>motif | B cell epitope probability in virus | B cell epitope probability in human protein | Uniprot identifier |
|---|---|---|---|---|---|
| Myelin-oligodendrocyte glycoprotein | SEQ 1161 | ETEAT | -0.65 | -1.74 | Q5SUK5_HUMAN |
| Synaptotagmin-like protein 2 | SEQ 1162 | PTTGE | -1.60 | -0.66 | SYTL2_HUMAN |
| Synaptopodin-2 | SEQ 1163 | KSGVT | -0.77 | -0.41 | SYNP2_HUMAN |
| Neuroendocrine convertase 2 | SEQ 1164 | GKGSI | -0.54 | -0.55 | NEC2_HUMAN |
| Putative neuroblastoma breakpoint family member 7 | SEQ 1165 | GSTSS | -1.41 | -1.49 | NBPF7_HUMAN |
| Synaptotagmin-16 | SEQ 1166 | STSSD | -1.75 | -1.78 | SYT16_HUMAN |
| Neurobeachin-like protein 2 | SEQ 1167 | QLGAS | -1.33 | -0.43 | NBEL2_HUMAN |
| Ceroid-lipofuscinosis neuronal protein 6 | SEQ 1168 | QLGAS | -1.33 | -0.78 | CLN6_HUMAN |
| Synaptogyrin-3 | SEQ 1169 | GASQA | -1.24 | -1.20 | SNG3_HUMAN |
| Synapsin-1 | SEQ 1170 | ASQAG | -1.00 | -0.49 | SYN1_HUMAN |
| Synaptopodin 2-like protein | SEQ 1171 | SQAGR | -0.78 | -0.47 | A6NCR3_HUMAN |
| Synaptotagmin-8 | SEQ 1172 | SPASS | -1.42 | -1.15 | F8WBL4_HUMAN |
| Motor neuron and pancreas homeobox protein 1 | SEQ 1167 | SPASS | -1.42 | -0.93 | MNX1_HUMAN |
| Hematological and neurological expressed 1 protein | SEQ 1173 | SPASS | -1.42 | -0.71 | HN1_HUMAN |
| Neurobeachin-like protein 2 | SEQ 1174 | LTSGH | -0.59 | -1.10 | NBEL2_HUMAN |

TABLE 34-continued

Neurologic protein mimics in USUV structural proteins

| USUV protein<br>Human protein<br>Envelope | SEQ<br>ID NO: | Pentamer motif | B cell epitope probability in virus | B cell epitope probability in human protein | Uniprot identifier |
|---|---|---|---|---|---|
| Neurogenic locus notch homolog protein 1 | SEQ 1175 | LKGTT | -0.73 | -0.40 | NOTC1_HUMAN |
| Synaptosomal-associated protein 29 | SEQ 1176 | VASSE | -1.21 | -0.41 | SNP29_HUMAN |
| Myelin transcription factor 1 | SEQ 1177 | ASSEA | -1.32 | -0.58 | MYT1_HUMAN |
| Calcineurin subunit B type 1 | SEQ 1178 | GDKQI | -0.83 | -0.91 | H7BYZ3_HUMAN |
| CMP-N-acetylneuraminate-poly-alpha-2 | SEQ 1179 | AGSSI | -1.28 | -0.63 | SIA8D_HUMAN |
| PrM | SEQ 1180 | | | | |
| Neurobeachin-like protein 1 | SEQ 1181 | STKAS | 0.83 | -1.50 | NBEL1_HUMAN |

TABLE 35

Cardiovascular protein mimics in USUV structural proteins

| USUV protein<br>Human protein<br>Envelope | SEQ<br>ID NO: | Pentamer motif | B cell epitope probability in virus | B cell epitope probability in human protein | Uniprot identifier |
|---|---|---|---|---|---|
| Brain-specific angiogenesis inhibitor 2 | SEQ 1182 | AKDKP | -0.76 | -1.85 | A2A3C1_HUMAN |
| Lymphatic vessel endothelial hyaluronic acid receptor 1 | SEQ 1183 | RAEDT | -1.15 | -0.43 | F2Z296_HUMAN |
| Vasopressin V2 receptor | SEQ 1184 | SGVTD | -1.01 | -0.60 | V2R_HUMAN |
| Uroplakin-3b | SEQ 1185 | GSIDT | -0.64 | -0.89 | A6NHH5_HUMAN |
| Plakophilin-4 | SEQ 1186 | GSTSS | -1.41 | -1.69 | PKP4_HUMAN |
| Erythroid differentiation-related factor 1 | SEQ 1187 | STSSD | -1.75 | -2.00 | EDRF1_HUMAN |
| Vascular endothelial growth factor B | SEQ 1188 | SSQLG | -1.12 | -0.65 | VEGFB_HUMAN |
| Serotransferrin | SEQ 1189 | LGASQ | -1.34 | -1.17 | F8WC57_HUMAN |
| Endothelial PAS domain-containing protein 1 | SEQ 1190 | TPNSP | -1.15 | -1.81 | EPAS1_HUMAN |
| C-C motif chemokine 19 | SEQ 1191 | WTSPA | -1.17 | -0.57 | CCL19_HUMAN |
| Endothelial transcription factor GATA-2 | SEQ 1192 | SPASS | -1.42 | -2.00 | GATA2_HUMAN |

TABLE 35-continued

| Cardiovascular protein mimics in USUV structural proteins | | | | | |
|---|---|---|---|---|---|
| USUV protein<br>Human protein<br>Envelope | SEQ<br>ID NO: | Pentamer motif | B cell epitope<br>probability in<br>virus | B cell epitope<br>probability in<br>human protein | Uniprot identifier |
| Hematological and neurological expressed 1 protein | SEQ 1193 | SPASS | -1.42 | -0.71 | HN1_HUMAN |
| C-C motif chemokine 23 | SEQ 1194 | ALGSQ | -0.76 | -0.53 | CCL23_HUMAN |
| Erythrocyte membrane protein band 4_2 | SEQ 1195 | QEGAL | -0.88 | -0.70 | EPB42_HUMAN |
| Desmoplakin | SEQ 1196 | TGSDG | -1.52 | -1.70 | DESP_HUMAN |
| Endothelial cell-specific chemotaxis regulator | SEQ 1197 | SSEAN | -1.25 | -0.50 | ECSCR_HUMAN |

TABLE 36

| Microcephaly related protein mimics in USUV structural proteins | | | | | |
|---|---|---|---|---|---|
| USUV protein<br>Human protein<br>Envelope | SEQ<br>ID NO: | Pentamer<br>motif | B cell<br>epitope<br>probability<br>in virus | B cell<br>epitope<br>probability<br>in human<br>protein | Uniprot identifier |
| CCDC19 protein | SEQ 1198 | METEA | -0.54 | -1.06 | Q05BA3_HUMAN |
| Centrosomal protein of 78 kDa | SEQ 1199 | STVSN | -0.62 | -0.87 | A8MST6_HUMAN |
| CDK5 and ABL1 enzyme substrate 2 | SEQ 1200 | KSGVT | -0.77 | -0.29 | CABL2_HUMAN |
| Centrosomal protein kizuna | SEQ 1201 | STSSD | -1.75 | -0.32 | KIZ_HUMAN |
| Centromere protein V | SEQ 1202 | ASQAG | -1.00 | -1.20 | CENPV_HUMAN |
| Microcephalin | SEQ 1203 | SPASS | -1.42 | -0.94 | MCPH1_HUMAN |
| CDK5 regulatory subunit-associated protein 2 | SEQ 1204 | QEGAL | -0.88 | -0.73 | CK5P2_HUMAN |
| Centromere protein O | SEQ 1205 | QEGAL | -0.88 | -1.57 | CENPO_HUMAN |
| Microcephalin | SEQ 1206 | SGSVK | -0.28 | -0.60 | MCPH1_HUMAN |
| Cdc42 effector protein 3 | SEQ 1207 | LSDLT | -0.51 | -0.37 | BORG2_HUMAN |
| Protein CASC5 | SEQ 1208 | SSEAN | -1.25 | -1.34 | CASC5_HUMAN |
| Centromere_kinetochore protein zw10 homolog | SEQ 1209 | GAQRL | -0.53 | -0.84 | ZW10_HUMAN |
| Centrosomal protein of 192 kDa | SEQ 1210 | ALGDT | -0.39 | -0.33 | E9PF99_HUMAN |

In particular the following mimics were considered potentially adverse in a vaccine and constructs are provided for sequences in which these mimics have been substituted by other motifs: ETEAT (SEQ ID NO.: 1161), STSSD (SEQ ID NO.: 1166), SSQLG (SEQ ID NO.: 1188), SPASS (SEQ ID NO.: 1192), SGSVK (SEQ ID NO.: 1206), ASSEA (SEQ ID NO.: 1177). The mutant sequences were reviewed to ensure that no new adverse mimics were created.

Seq.1211. E_KJ438705env SA, Nucleotide Sequence
1-63 Signal peptide
70-1569 E_KJ438705 envelope protein Seq.1212. E_KJ438705env SA, Amino Acid Sequence
1-21 Signal peptide
24-523 E_KJ438705 envelope protein Seq.1213. E_KJ438705-EKL-hG1(CH2-CH3), Nucleotide Sequence
1-63 Signal peptide
70-1569 E_KJ438705 envelope protein
1570-1593 Enterokinase Linker
1600-2295 hG1(CH2-CH3) Constant region Seq.1214. E_KJ438705-EKL-hG1(CH2-CH3), Amino Acid Sequence
1-21 Signal peptide
24-523 E_KJ438705 envelope protein
524-531 Enterokinase Linker
534-765 hG1(CH2-CH3) Constant region Seq.1215. MutantUSUV_Env SA, Nucleotide Sequence
1-63 Signal peptide
70-1569 MutantUSUV envelope protein Seq.1216. MutantUSUV_Env SA, Amino Acid Sequence
1-21 Signal peptide
24-523 MutantUSUV envelope protein Seq.1217. MutantUSUV-EKL-hG1(CH2-CH3), Nucleotide Sequence
1-63 Signal peptide
70-1569 MutantUSUV envelope protein
1570-1593 Enterokinase Linker
1600-2295 hG1(CH2-CH3) Constant region Seq.1218. MutantUSUV-EKL-hG1(CH2-CH3), Amino Acid Sequence
1-21 Signal peptide
24-523 MutantUSUV envelope protein
524-531 Enterokinase Linker
534-765 hG1(CH2-CH3) Constant region Diagnostic Applications to Differentiate USUV Epitope pentamers were selected from USUV which are conserved and which are distinct from other co-endemic flaviviruses. These were evaluated against other flaviviruses and a subset of pentamers identified which can be included in a diagnostic peptide array to distinguish Usutu virus.

From the envelope the following peptides were selected from USUV as shown in Table 37

TABLE 37

Peptides from USUV envelope protein for diagnostic arrays

| SEQ ID NO: | Pentamer | B Cell Epitope probability | Position in USUV ENV | Flanking regions | SEQ ID NO: |
|---|---|---|---|---|---|
| SEQ 1219 | PTTGE | -1.60 | 77 | TGEAHNPKRAEDTYV | 1287 |
| SEQ 1220 | NPKRA | -1.76 | 84 | KRAEDTYVCKSGVTD | 1288 |
| SEQ 1221 | SSDTH | -2.09 | 150 | DTHGNYSSQLGASQA | 1289 |
| SEQ 1222 | HGNYS | -1.35 | 154 | NYSSQLGASQAGRFT | 1290 |
| SEQ 1223 | PNSPA | -1.19 | 173 | SPAITVKMGDYGEIS | 1291 |
| SEQ 1224 | PRNGL | -1.13 | 194 | NGLNTEAYYIMSVGT | 1292 |
| SEQ 1225 | TSPAS | -1.27 | 228 | PASSNWRNREILLEF | 1293 |
| SEQ 1226 | PASSN | -1.52 | 230 | SSNWRNREILLEFEE | 1294 |
| SEQ 1227 | PHATK | -1.17 | 247 | ATKQSVVALGSQEGA | 1295 |
| SEQ 1228 | FAKNP | -1.04 | 312 | KNPADTGHGTVVLEL | 1296 |
| SEQ 1229 | TGSDG | -1.52 | 331 | SDGPCKIPISIVASL | 1297 |
| SEQ 1230 | ASSEA | -1.32 | 364 | SEANAKVLVEMEPPF | 1298 |

These pentamers were determined to be highly conserved in 68 USUV envelope proteins examined. Cross reactivity was checked against a panel of other flaviviruses and the E2 protein of chikungunya. Table 38 shows that there is little cross reactivity except in those peptides designated as "Pan-Flavi". Furthermore peptides previously selected as distinguishing epitopes of the other flaviviruses (see, e.g., copending U.S. Prov. Applications 62/286,779; 62/290,616; 62/292,964; 62/306,264; 62/321,375; and 62/350,881; each of which is incorporated herein by reference in its entirety) were shown to be absent from the 68 USUV envelope proteins examined.

TABLE 38

| Virus | Peptide # | B cell epitope probaility | Position in ENV | Flanking regions | SEQ ID NO.: | Penta-mer | SEQ ID NO.: | Den N1 | Den2 | Den3 | Den4 | YF | WNV | ZILV | Chik | USUV |
|---|---|---|---|---|---|---|---|---|---|---|---|---|---|---|---|---|
| DEN1 | 1 | −1.04 | 51 | ELLKTEVTNPAVLRK | 446 | EVTNP | 519 | 186 | 0 | 0 | 0 | 0 | 0 | 0 | 0 | 0 |
| DEN1 | 2 | −1.84 | 168 | IATITPQAPTSEIQL | 447 | PQAPT | 520 | 187 | 0 | 0 | 0 | 0 | 0 | 0 | 0 | 0 |
| DEN1 | 3 | −2.09 | 227 | WTSGASTSQETWNRQ | 448 | STSQE | 521 | 188 | 0 | 0 | 0 | 0 | 0 | 0 | 0 | 0 |
| DEN1 | 4 | −1.57 | 272 | TGATEIQTSGTTTIF | 449 | IQTSG | 522 | 192 | 0 | 3 | 0 | 0 | 0 | 0 | 0 | 0 |
| DEN1 | 5 | −1.55 | 329 | VQVKYEGTDAPCKTP | 450 | EGTDA | 523 | 190 | 0 | 0 | 0 | 0 | 0 | 0 | 0 | 0 |
| DEN1 | 6 | −1.77 | 344 | FLTQDEKGVTQNGRL | 451 | EKGVT | 524 | 185 | 0 | 0 | 0 | 0 | 0 | 0 | 0 | 0 |
| DEN1 | 7 | −0.99 | 361 | ANPIVTDKEKPVNIE | 452 | TDKEK | 525 | 191 | 0 | 0 | 0 | 0 | 0 | 0 | 0 | 0 |
| DEN1 | 8 | −1.55 | 371 | PVNIETEPPFGESYI | 453 | TEPPF | 526 | 191 | 0 | 0 | 0 | 0 | 0 | 0 | 0 | 0 |
| DEN2 | 1 | −1.65 | 226 | WLPGADTQGSNWIQK | 454 | DTQGS | 527 | 0 | 215 | 0 | 0 | 0 | 0 | 0 | 0 | 0 |
| DEN2 | 2 | −1.13 | 228 | PGADTQGSNWIQKET | 455 | QGSNW | 528 | 0 | 215 | 0 | 0 | 0 | 0 | 0 | 0 | 0 |
| DEN2 | 3 | −1.44 | 244 | VTFKNPHAKKQDVVV | 456 | PHAKK | 529 | 0 | 215 | 0 | 0 | 0 | 0 | 0 | 0 | 0 |
| DEN2 | 4 | −1.74 | 328 | IRVQYEGDGSPCKIP | 457 | EGDGS | 530 | 0 | 215 | 0 | 0 | 0 | 0 | 0 | 0 | 0 |
| DEN2 | 5 | −1.27 | 330 | VQYEGDGSPCKIPFE | 458 | DGSPC | 531 | 0 | 215 | 0 | 0 | 0 | 0 | 0 | 0 | 0 |
| DEN2 | 6 | −1.28 | 362 | PIVTEKDSPVNIEAE | 459 | KDSPV | 532 | 0 | 212 | 0 | 0 | 0 | 0 | 0 | 0 | 0 |
| DEN2 | 7 | −1.53 | 370 | PVNIEAEPPFGDSYI | 460 | AEPPF | 533 | 1 | 215 | 208 | 0 | 0 | 0 | 0 | 0 | 0 |
| DEN2 | 8 | −1.14 | 372 | NIEAEPPFGDSYIIV | 461 | PPFGD | 534 | 0 | 215 | 0 | 433 | 48 | 0 | 0 | 0 | 66 |
| DEN3 | 1 | −1.49 | 154 | QHQVGNETQGVTAEI | 462 | NETQG | 535 | 0 | 0 | 206 | 0 | 0 | 0 | 0 | 0 | 0 |
| DEN3 | 2 | −2.03 | 224 | WTSGATTETPTWNRK | 463 | TTETP | 536 | 0 | 0 | 205 | 0 | 0 | 0 | 0 | 0 | 0 |
| DEN3 | 3 | −1.63 | 269 | TGATEIQNSGGTSIF | 464 | IQNSG | 537 | 0 | 0 | 203 | 0 | 0 | 0 | 0 | 0 | 0 |
| DEN3 | 4 | −1.63 | 311 | VLKKEVSETQHGTIL | 465 | VSETQ | 538 | 0 | 0 | 208 | 0 | 0 | 0 | 0 | 0 | 0 |
| DEN3 | 5 | −1.24 | 327 | KVEYKGEDAPCKIPF | 466 | GEDAP | 539 | 0 | 0 | 145 | 0 | 0 | 0 | 0 | 0 | 0 |
| DEN3 | 6 | −1.02 | 327 | KVEYKGEDVPCKIFF | 467 | GEDVP | 540 | 0 | 0 | 62 | 0 | 0 | 0 | 0 | 0 | 0 |
| DEN3 | 7 | −1.31 | 336 | PCKIPFSTEDGQGKA | 468 | FSTED | 541 | 0 | 0 | 208 | 0 | 0 | 0 | 0 | 0 | 0 |
| DEN3 | 8 | −1.17 | 360 | PVVTKKEEPVNIEAE | 469 | KEEPV | 542 | 0 | 0 | 191 | 0 | 0 | 0 | 0 | 0 | 0 |
| DEN3 | 9 | −1.57 | 369 | VNIEAEPPFGESNIV | 470 | EPPFG | 543 | 192 | 215 | 208 | 433 | 0 | 0 | 0 | 0 | 66 |
| DEN4 | 1 | −1.18 | 48 | DFELTKTTAKEVALL | 471 | KTTAK | 544 | 0 | 0 | 0 | 431 | 0 | 0 | 0 | 0 | 0 |
| DEN4 | 2 | −1.68 | 155 | HAVGNDTSNHGVTAT | 472 | DTSNH | 545 | 0 | 0 | 0 | 430 | 0 | 0 | 0 | 0 | 0 |
| DEN4 | 3 | −1.59 | 166 | VTATITPRSPSVEVE | 473 | TPRSP | 546 | 0 | 0 | 0 | 433 | 0 | 0 | 0 | 0 | 0 |
| DEN4 | 4 | −1.62 | 272 | GATEVDSGDGNHMFA | 474 | DSGDG | 547 | 0 | 0 | 0 | 424 | 0 | 0 | 0 | 0 | 0 |
| DEN4 | 5 | −1.29 | 315 | DKEMAETQHGTTVVK | 475 | ETQHG | 548 | 192 | 215 | 208 | 433 | 5 | 0 | 0 | 0 | 0 |
| DEN4 | 6 | −1.44 | 328 | VKVKYEGAGAPCKVP | 476 | EGAGA | 549 | 0 | 0 | 0 | 431 | 0 | 0 | 0 | 0 | 0 |
| DEN4 | 7 | −1.06 | 358 | ISSIPLAENTNSVTN | 477 | LAENT | 550 | 0 | 0 | 0 | 431 | 0 | 0 | 0 | 0 | 0 |
| DEN4 | 8 | −1.05 | 362 | PLAENTNSVTNIELE | 478 | TNSVT | 551 | 0 | 0 | 0 | 423 | 0 | 0 | 0 | 0 | 0 |
| PAN DEN | 1 | | 313 | | | ETQHG | 548 | 192 | 215 | 208 | 433 | 0 | 0 | 0 | 0 | 0 |
| PAN DEN | 2 | | 369 | | | EPPFG | 549 | 192 | 215 | 208 | 433 | 0 | 51 | 0 | 0 | 67 |
| PAN DEN | 3 | | 99 | | | DRGWG | 550 | 192 | 215 | 208 | 433 | 48 | 50 | 41 | 0 | 66 |
| PAN DEN | 4 | | 185 | | | SPRTG | 551 | 192 | 215 | 207 | 0 | 0 | 0 | 0 | 0 | 0 |
| PAN DEN | 5 | | 404 | | | TARGA | 552 | 192 | 0 | 207 | 0 | 0 | 0 | 0 | 0 | 0 |
| PAN DEN | 6 | | 394 | | | GSSIG | 553 | 192 | 214 | 208 | 433 | 48 | 51 | 0 | 0 | 68 |
| PAN DEN | 7 | | 74 | | | RCPTQ | 554 | 192 | 215 | 208 | 433 | 0 | 0 | 41 | 0 | 0 |
| PAN DEN | 8 | | 370 | | | PPFGD | 555 | 0 | 215 | 0 | 433 | 48 | 51 | 41 | 0 | 66 |
| YF | 1 | −1.04 | 52 | ETVAIDRPAEVRKVC | 479 | DRPAE | 560 | 0 | 0 | 0 | 0 | 4 | 0 | 0 | 0 | |
| YF | 2 | −1.25 | 150 | HVGAKQENWNTDIKT | 480 | QENWN | 561 | 0 | 0 | 0 | 0 | 39 | 0 | 0 | 0 | |
| YF | 3 | −1.22 | 165 | LKFDALSGSQEVEFI | 481 | LSGSQ | 562 | 0 | 0 | 0 | 0 | 48 | 0 | 0 | 0 | |
| YF | 4 | −1.08 | 218 | DLTLPWQSGSGGVWR | 482 | WQSGS | 563 | 0 | 0 | 0 | 0 | 48 | 0 | 0 | 0 | |
| YF | 5 | −1.50 | 250 | VLALGNQEGSLKTAL | 483 | NQEGS | 564 | 0 | 0 | 0 | 0 | 44 | 0 | 0 | 0 | |
| YF | 6 | −1.73 | 267 | AMRVTKDTNDNNLYK | 484 | KDTND | 565 | 0 | 0 | 0 | 0 | 25 | 0 | 0 | 0 | |
| YF | 7 | −2.21 | 311 | FFVKNPTDTGHGTVV | 485 | PTDTG | 566 | 0 | 0 | 0 | 0 | 47 | 0 | 0 | 0 | |
| YF | 8 | −1.30 | 358 | VNPIASTNDDEVLIE | 486 | STNDD | 567 | 0 | 0 | 0 | 0 | 46 | 0 | 0 | 0 | |
| YF | 9 | −1.61 | 356 | VTVNPIASTNDDEVL | 487 | IASTN | 568 | 0 | 0 | 0 | 0 | 48 | 0 | 0 | 0 | |
| YF | 10 | −1.03 | 369 | VLIEVNPPFGDSYII | 488 | NPPFG | 569 | 0 | 0 | 0 | 0 | 48 | 0 | 0 | 0 | |
| WNV | 1 | −1.52 | 38 | TIMSKDKPTIDVKMM | 489 | DKPTI | 1247 | 0 | 0 | 0 | 0 | 0 | 49 | 0 | 0 | 0 |
| WNV | 2 | −1.11 | 148 | FVHGPTTVESHGKIG | 490 | TTVES | 1248 | 0 | 0 | 0 | 0 | 0 | 51 | 0 | 0 | 0 |
| WNV | 3 | −1.21 | 188 | VTVDCEPRSGIDTSA | 491 | EPRSG | 1249 | 0 | 0 | 0 | 433 | 0 | 51 | 0 | 0 | 0 |
| WNV | 4 | −1.07 | 253 | SVVALGSQEGALHQA | 492 | GSQEG | 1250 | 192 | 215 | 208 | 432 | 0 | 51 | 40 | 0 | 0 |
| WNV | 5 | −0.81 | 295 | EKLQLKGTTYGVCSK | 493 | KGTTY | 1251 | 0 | 0 | 0 | 0 | 0 | 51 | 0 | 0 | 0 |
| WNV | 6 | −1.86 | 312 | KFARTPADTGHGTVV | 494 | PADTG | 1252 | 0 | 0 | 0 | 0 | 0 | 51 | 0 | 0 | 0 |
| WNV | 7 | −1.50 | 327 | LELQYTGTDGPCKVP | 495 | TGTDG | 1253 | 0 | 0 | 0 | 0 | 0 | 49 | 0 | 0 | 0 |
| WNV | 8 | −0.90 | 385 | YIVVGRGEQQINHHW | 496 | RGEQQ | 1254 | 0 | 0 | 0 | 0 | 0 | 51 | 0 | 0 | 0 |
| ZIKV | 1 | −0.62 | 16 | DFVEGMSGGTWVDIV | 497 | MSGGT | 1255 | 0 | 0 | 0 | 0 | 0 | 0 | 41 | 0 | 0 |
| ZIKV | 2 | −1.21 | 38 | TVMAQDKPTVDIELV | 498 | DKPTV | 1256 | 0 | 0 | 0 | 0 | 0 | 0 | 41 | 0 | 0 |

TABLE 38-continued

| Virus | Peptide # | B cell epitope probaility | Position in ENV | Flanking regions | SEQ ID NO.: | Pentamer | SEQ ID NO.: | Den N1 | Den2 | Den3 | Den4 | YF | WNV | ZILV | Chik | USUV |
|---|---|---|---|---|---|---|---|---|---|---|---|---|---|---|---|---|
| ZIKV | 3 | -1.41 | 86 | AYLDKQSDTQYVCKR | 499 | QSDTQ | 570 | 0 | 0 | 0 | 0 | 0 | 0 | 41 | 0 | 0 |
| ZIKV | 4 | -1.37 | 128 | SKKMTGKSIQPENLE | 500 | GKSIQ | 571 | 0 | 0 | 0 | 0 | 0 | 0 | 41 | 0 | 0 |
| ZIKV | 5 | -0.84 | 145 | IMLSVHGSQHSGMIV | 501 | HGSQH | 572 | 0 | 0 | 0 | 0 | 0 | 0 | 41 | 0 | 0 |
| ZIKV | 6 | -2.20 | 159 | VNDTGHETDENRAKV | 502 | HETDE | 573 | 0 | 0 | 0 | 0 | 0 | 0 | 41 | 0 | 0 |
| ZIKV | 7 | -2.01 | 172 | KVEITPNSPRAEATL | 503 | PNSPR | 574 | 0 | 0 | 0 | 0 | 0 | 0 | 41 | 0 | 0 |
| ZIKV | 8 | -1.70 | 175 | ITPNSPRAEATLGGF | 504 | PRAEA | 575 | 0 | 0 | 0 | 0 | 0 | 0 | 41 | 0 | 0 |
| ZIKV | 9 | -1.55 | 233 | AGADTGTPHWNNKEA | 505 | GTPHW | 576 | 0 | 0 | 0 | 0 | 0 | 0 | 41 | 0 | 0 |
| ZIKV | 10 | -1.47 | 282 | EMDGAKGRLSSGHLK | 506 | KGRLS | 577 | 0 | 0 | 0 | 0 | 0 | 0 | 41 | 0 | 0 |
| ZIKV | 11 | -1.56 | 335 | EVQYAGTDGPCKVPA | 507 | GTDGP | 578 | 0 | 0 | 0 | 0 | 0 | 50 | 40 | 0 | 0 |
| ZIKV | 12 | -1.14 | 365 | ITANPVITESTENSK | 508 | VITES | 579 | 0 | 0 | 0 | 0 | 0 | 0 | 41 | 0 | 0 |
| ZIKV | 13 | -1.51 | 368 | NPVITESTENSKMML | 509 | ESTEN | 580 | 0 | 0 | 0 | 0 | 0 | 0 | 41 | 0 | 0 |
| ZIKV | 14 | -1.05 | 370 | VITESTENSKMMLEL | 510 | TENSK | 581 | 0 | 0 | 0 | 0 | 0 | 0 | 41 | 0 | 0 |
| CHIK | 1 | -1.14 | 40 | ALERIRNEATDGTLK | 511 | RNEAT | 582 | 0 | 0 | 0 | 0 | 0 | 0 | 0 | 30 | 0 |
| CHIK | 2 | -1.21 | 144 | GREKFHSRPQHGKEL | 512 | HSRPQ | 583 | 0 | 0 | 0 | 0 | 0 | 0 | 0 | 30 | 0 |
| CHIK | 3 | -1.18 | 249 | VPRNAELGDRKGKIH | 513 | EFGDR | 584 | 0 | 0 | 0 | 0 | 0 | 0 | 0 | 30 | 0 |
| CHIK | 4 | -1.46 | 274 | RVPKARNPTVTYGKN | 514 | RNPTV | 585 | 0 | 0 | 0 | 0 | 0 | 0 | 0 | 30 | 0 |
| CHIK | 5 | -1.14 | 276 | PKARNPTVTYGKNQV | 515 | PTVTY | 586 | 0 | 0 | 0 | 0 | 0 | 0 | 0 | 30 | 0 |
| CHIK | 6 | -1.27 | 303 | SYRNMGEEPNYQEEW | 516 | GEEPN | 587 | 0 | 0 | 0 | 0 | 0 | 0 | 0 | 30 | 0 |
| CHIK | 7 | -0.70 | 334 | EVTWGNNEPYKYWPQ | 517 | NNEPY | 588 | 0 | 0 | 0 | 0 | 0 | 0 | 0 | 30 | 0 |
| CHIK | 8 | -1.33 | 347 | PQLSTNGTAHGHPHE | 518 | NGTAH | 589 | 0 | 0 | 0 | 0 | 0 | 0 | 0 | 30 | 0 |
| USUV | 1 | -1.60 | 77 | TGEAHNPKRAEDTYV | 1287 | PTTGE | 1219 | 0 | 0 | 0 | 0 | 0 | 0 | 0 | 0 | 68 |
| USUV | 2 | -1.76 | 84 | KRAEDTYVCKSGVTD | 1288 | NPKRA | 1220 | 0 | 0 | 0 | 0 | 0 | 0 | 0 | 0 | 68 |
| USUV | 3 | -2.09 | 150 | DTHGNYSSQLGASQA | 1289 | SSDTH | 1221 | 0 | 0 | 0 | 0 | 0 | 0 | 0 | 0 | 67 |
| USUV | 4 | -1.35 | 154 | NYSSQLGASQAGRFT | 1290 | HGNYS | 1222 | 0 | 0 | 0 | 0 | 0 | 51 | 0 | 0 | 68 |
| USUV | 5 | -1.19 | 173 | SPAITVKMGDYGEIS | 1291 | PNSPA | 1223 | 0 | 0 | 0 | 0 | 0 | 0 | 0 | 0 | 67 |
| USUV | 6 | -1.13 | 194 | NGLNTEAYYIMSVGT | 1292 | PRNGL | 1224 | 0 | 0 | 0 | 0 | 0 | 0 | 0 | 0 | 68 |
| USUV | 7 | -1.27 | 228 | PASSNWRNREILLEF | 1293 | TSPAS | 1225 | 0 | 0 | 0 | 0 | 0 | 0 | 0 | 0 | 68 |
| USUV | 8 | -1.52 | 230 | SSNWRNREILLEFEE | 1294 | PASSN | 1226 | 0 | 0 | 0 | 0 | 0 | 0 | 0 | 0 | 67 |
| USUV | 9 | -1.17 | 247 | ATKQSVVALGSQEGA | 1295 | PHATK | 1227 | 0 | 0 | 0 | 0 | 0 | 51 | 0 | 0 | 68 |
| USUV | 10 | -1.04 | 312 | KNPADTGHGTVVLEL | 1296 | FAKNP | 1228 | 0 | 0 | 0 | 0 | 0 | 0 | 0 | 0 | 68 |
| USUV | 11 | -1.52 | 331 | SDGPCKIPISIVASL | 1297 | TGSDG | 1229 | 0 | 0 | 0 | 0 | 0 | 1 | 0 | 0 | 67 |
| USUV | 12 | -1.32 | 364 | SEANAKVLVEMEPPF | 1298 | ASSEA | 1230 | 0 | 0 | 0 | 0 | 0 | 0 | 0 | 0 | 68 |

The selected envelope USUV pentamer peptides were then evaluated against other pathogens of interest that are co-endemic. Some cross reactivity with SLE, JAEV and Hepatitis C was noted for peptides PTTGE (SEQ ID NO.: 1162), HGNYS (SEQ ID NO.: 1222), PHATK (SEQ ID NO.: 1227) and FAKNP (SEQ ID NO.: 1228). As has been noted with other flaviviruses, some cross reactivity was found with *Plasmodium falciparum*. The parvovirus 19, enteroviruses and alphaviruses showed no similarity

TABLE 39

Evaluation of potential cross reactivity between USUV pentaniers and other pathogens

| | SEQ ID NO.: | SLE | HEPC | JAEV | Parvo19 | Entero | Ross River | EEE | *Plasmodium falciparum* |
|---|---|---|---|---|---|---|---|---|---|
| Isolates tested | | 3 | 539 | 11 | 225 | 90 | 12 | 4 | 1 |
| Proteins | | 24 | 539 | 11 | 225 | 990 | 109 | 44 | 5392 |
| USUV peptide | | | | | | | | | |
| PTTGE | 1162 | 24 | 42 | 23 | 0 | 0 | 0 | 0 | 1 |
| NPKRA | 1220 | 0 | 0 | 0 | 0 | 0 | 0 | 0 | 0 |
| SSDTH | 1221 | 0 | 0 | 0 | 0 | 0 | 0 | 0 | 3 |
| HGNYS | 1222 | 20 | 2 | 23 | 0 | 0 | 0 | 0 | 1 |
| PNSPA | 1223 | 0 | 0 | 0 | 0 | 0 | 0 | 0 | 2 |
| PRNGL | 1224 | 0 | 0 | 0 | 0 | 0 | 0 | 0 | 2 |
| TSPAS | 1225 | 0 | 0 | 0 | 0 | 0 | 0 | 0 | 1 |

TABLE 39-continued

Evaluation of potential cross reactivity between USUV pentaniers and other pathogens

| | SEQ ID NO.: | SLE | HEPC | JAEV | Parvo19 | Entero | Ross River | EEE | *Plasmodium falciparum* |
|---|---|---|---|---|---|---|---|---|---|
| PASSN | 1226 | 0 | 0 | 0 | 0 | 0 | 0 | 0 | 0 |
| PHATK | 1227 | 24 | 3 | 0 | 0 | 0 | 0 | 0 | 0 |
| FAKNP | 1228 | 0 | 0 | 19 | 0 | 0 | 0 | 0 | 0 |
| TGSDG | 1229 | 0 | 0 | 0 | 0 | 0 | 0 | 0 | 0 |
| ASSEA | 1230 | 0 | 0 | 0 | 0 | 2 | 0 | 0 | 2 |

A similar selection and evaluation of peptides was then made from USUV NS1. The following peptides were selected as diagnostic array for USUV.

TABLE 40

Peptides from USUV NS1 protein

| | Pentamer | Bepi Epitope probability | Position in NS1 | Flanking regions | SEQ ID NO.: |
|---|---|---|---|---|---|
| SEQ 1231 | MPETP | -1.05 | 37 | DRYKFMPETPKQLAK | 1299 |
| SEQ 1232 | PKGMY | -1.07 | 95 | VVVEKPKGMYKSAPQ | 1300 |
| SEQ 1233 | PETKE | -1.55 | 140 | FVVDGPETKECPDVK | 1301 |
| SEQ 1234 | HNTTD | -1.44 | 176 | LKVREHNTTDCDSSI | 1302 |
| SEQ 1235 | PKSNH | -1.81 | 252 | VTLAGPKSNHNRREG | 1303 |
| SEQ 1236 | QGPWD | -1.58 | 267 | YKVQSQGPWDEEDIV | 1304 |
| SEQ 1237 | SIRTT | -1.52 | 299 | GKRGPSIRTTTSSGR | 1305 |
| SEQ 1238 | RTTTS | -1.54 | 301 | RGPSIRTTTSSGRLV | 1306 |

When compared to pentamers selected for other flaviviruses (see, e.g., copending U.S. Prov. Applications 62/286,779; 62/290,616; 62/292,964; 62/306,264; 62/321,375; and 62/350,881; each of which is incorporated herein by reference in its entirety) no cross reactivity was seen except for with WNV as seen in Table 41

TABLE 41

NS1 peptides from USUV showing lack of cross reactivity with other flavivirus pentamers selected for a diagnostic array.

| Virus | # | Bepi Prob | Pos | Pent-ainer | SEQ ID NO.: | Flanking | SEQ ID NO.: | Den1 | Den2 | Den3 | Den4 | WNV | YF | ZIKV | USUV |
|---|---|---|---|---|---|---|---|---|---|---|---|---|---|---|---|
| DEN1 | 1 | -1.45 | 38 | DSPKR | 647 | YKFQADSPKRLSAAI | 590 | 74 | 0 | 160 | 0 | 0 | 0 | 0 | 0 |
| DEN1 | 2 | -0.75 | 104 | MIRPQ | 648 | AQGKKMIRPQPMEHK | 591 | 70 | 0 | 0 | 0 | 0 | 0 | 0 | 0 |
| DEN1 | 3 | -1.84 | 141 | TPECP | 649 | IDGPDTPECPDGQRA | 592 | 73 | 0 | 160 | 0 | 0 | 0 | 0 | 0 |
| DEN1 | 4 | -1.27 | 144 | CPDGQ | 650 | PDTPECPDGQRAWNI | 593 | 43 | 0 | 0 | 0 | 0 | 0 | 0 | 0 |
| DEN1 | 5 | -0.94 | 190 | KDSKA | 651 | MSAAIKDSKAVHADM | 594 | 74 | 0 | 0 | 0 | 0 | 0 | 0 | 0 |
| DEN1 | 6 | -1.17 | 206 | EKNET | 652 | YWIESEKNETWKLAR | 595 | 74 | 0 | 0 | 0 | 0 | 0 | 0 | 0 |
| DEN1 | 7 | -1.46 | 294 | NRGPS | 653 | DEHCGNRGPSLRTTT | 596 | 47 | 108 | 0 | 0 | 0 | 0 | 0 | 0 |
| DEN1 | 8 | -0.81 | 301 | TTTVT | 654 | GPSLRTTTVTGKIIH | 597 | 74 | 0 | 0 | 0 | 0 | 0 | 0 | 0 |
| DEN2 | 1 | -1.50 | 39 | SPSKL | 655 | KFQPESPSKLASAIQ | 598 | 0 | 107 | 0 | 0 | 0 | 0 | 0 | 0 |
| DEN2 | 2 | -2.00 | 105 | LRPQP | 656 | AGKRSLRPQPTELKY | 599 | 0 | 105 | 0 | 0 | 0 | 0 | 0 | 0 |
| DEN2 | 3 | -1.15 | 126 | STESH | 657 | KAKMLSTESHNQTFL | 600 | 0 | 97 | 0 | 0 | 0 | 0 | 0 | 0 |
| DEN2 | 4 | -1.43 | 142 | AECPN | 658 | DGPETAECPNTNRAW | 601 | 0 | 106 | 0 | 0 | 0 | 0 | 0 | 0 |
| DEN2 | 5 | -0.83 | 191 | DNRAV | 659 | SAAIKDNRAVHADMG | 602 | 0 | 106 | 0 | 0 | 0 | 0 | 0 | 0 |
| DEN2 | 6 | -1.03 | 248 | FAGPV | 660 | IIPKNFAGPVSQHNY | 603 | 0 | 105 | 0 | 0 | 0 | 0 | 0 | 0 |
| DEN2 | 7 | -1.02 | 262 | HTQTA | 661 | YRPGYHTQTAGPWHL | 604 | 0 | 105 | 159 | 0 | 0 | 0 | 0 | 0 |
| DEN2 | 8 | -1.37 | 291 | DCGNR | 662 | VVVTEDCGNRGPSLR | 605 | 0 | 106 | 0 | 0 | 0 | 0 | 0 | 0 |

TABLE 41-continued

NS1 peptides from USUV showing lack of cross reactivity with other flavivirus pentamers selected for a diagnostic array.

| Virus | # | Bepi Prob | Pos | Pent- ainer | SEQ ID NO.: | Flanking | SEQ ID NO.: | Den1 | Den2 | Den3 | Den4 | WNV | YF | ZIKV | USUV |
|---|---|---|---|---|---|---|---|---|---|---|---|---|---|---|---|
| DEN3 | 1 | −1.40 | 37 | ADSPK | 663 | QYKFQADSPKRLATA | 606 | 74 | 0 | 160 | 0 | 0 | 0 | 0 | 0 |
| DEN3 | 2 | −1.33 | 103 | RTLTP | 664 | LKQGKRTLTPQPMEL | 607 | 0 | 0 | 1.58 | 0 | 0 | 0 | 0 | 0 |
| DEN3 | 3 | −1.80 | 140 | NTPEC | 665 | IIDGPNTPECPSASR | 608 | 1 | 0 | 157 | 0 | 0 | 0 | 0 | 0 |
| DEN3 | 4 | −0.90 | 190 | KDERA | 666 | MSAAVKDERAVHADM | 609 | 0 | 0 | 159 | 0 | 0 | 0 | 0 | 0 |
| DEN3 | 5 | −1.32 | 207 | KNGSW | 667 | WIESQKNGSWKLEKA | 610 | 0 | 0 | 160 | 0 | 0 | 0 | 0 | 0 |
| DEN3 | 6 | −1.11 | 257 | HRPGY | 668 | ISQHNHRPGYHTQTA | 611 | 0 | 0 | 141 | 0 | 0 | 0 | 0 | 0 |
| DEN3 | 7 | −0.86 | 290 | ENCGT | 669 | TVVITENCGTRGPSL | 612 | 0 | 0 | 160 | 0 | 0 | 0 | 0 | 0 |
| DEN3 | 8 | −0.86 | 301 | TTTVS | 670 | GPSLRTTTVSGKLIH | 613 | 0 | 0 | 160 | 0 | 0 | 0 | 0 | 0 |
| DEN4 | 1 | −1.18 | 39 | SPARL | 671 | KFQPESPARLASAIL | 614 | 0 | 0 | 0 | 29 | 0 | 0 | 0 | 0 |
| DEN4 | 2 | −1.63 | 104 | ALTPP | 672 | TKGKRALTPPVSDLK | 615 | 0 | 0 | 0 | 26 | 0 | 0 | 0 | 0 |
| DEN4 | 3 | −1.07 | 125 | FTPEA | 673 | GKAKIFTPEARNSTF | 616 | 0 | 0 | 0 | 28 | 0 | 0 | 0 | 0 |
| DEN4 | 4 | −1.81 | 140 | DTSEC | 674 | LIDGPDTSECPNERR | 617 | 0 | 0 | 0 | 29 | 0 | 0 | 0 | 0 |
| DEN4 | 5 | −1.25 | 207 | KNQTW | 675 | WIESSKNQTWQIEKA | 618 | 0 | 0 | 0 | 29 | 0 | 0 | 0 | 0 |
| DEN4 | 6 | −1.20 | 248 | YAGPF | 676 | LIPKSYAGPFSQHNY | 619 | 0 | 0 | 0 | 28 | 0 | 0 | 0 | 0 |
| DEN4 | 7 | −1.01 | 260 | GYATQ | 677 | HNYRQGYATQTVGPW | 620 | 0 | 0 | 0 | 29 | 0 | 0 | 0 | 0 |
| DEN4 | 8 | −1.19 | 292 | CDHRG | 678 | TIQEDCDHRGPSLRT | 621 | 0 | 0 | 0 | 29 | 0 | 0 | 0 | 0 |
| WNV | 1 | −1.69 | 38 | PETPQ | 679 | RYKYYPETPQGLAKI | 622 | 0 | 0 | 0 | 0 | 52 | 0 | 0 | 0 |
| WNV | 2 | −1.16 | 102 | APKRL | 680 | GMYKSAPKRLTATTE | 623 | 0 | 0 | 0 | 0 | 51 | 0 | 0 | 0 |
| WNV | 3 | −1.43 | 144 | ECPTQ | 681 | GPETKECPTQNRAWN | 624 | 0 | 0 | 0 | 0 | 51 | 0 | 0 | 0 |
| WNV | 4 | −1.74 | 177 | NTTEC | 682 | KVRESNTTECDSKII | 625 | 0 | 0 | 0 | 0 | 52 | 0 | 0 | 1 |
| WNV | 5 | −1.47 | 261 | GYKTQ | 683 | HNRRPGYKTQNQGPW | 626 | 0 | 0 | 0 | 0 | 52 | 0 | 0 | 0 |
| WNV | 6 | −1.90 | 266 | NQGPW | 684 | GYKTQNQGPWDEGRV | 627 | 0 | 0 | 0 | 0 | 52 | 0 | 0 | 0 |
| WNV | 7 | −1.67 | 297 | GPATR | 685 | SCGHRGPATRTTTES | 628 | 0 | 0 | 0 | 0 | 52 | 0 | 0 | 0 |
| WNV | 8 | −1.54 | 303 | TTESG | 686 | PATRTTTESGKLITD | 629 | 0 | 0 | 0 | 0 | 51 | 0 | 0 | 0 |
| YF | 1 | −1.21 | 35 | YYPED | 687 | LNKYSYYPEDPVKLA | 630 | 0 | 0 | 0 | 0 | 0 | 72 | 0 | 0 |
| YF | 2 | −1.41 | 140 | SRKEC | 688 | IIDGKSRKECPFSNR | 631 | 0 | 0 | 0 | 0 | 0 | 72 | 0 | 0 |
| YF | 3 | −2.21 | 193 | KSAHG | 689 | AVNGKKSAHGSPTFW | 632 | 0 | 0 | 0 | 0 | 0 | 72 | 0 | 0 |
| YF | 4 | −1.12 | 234 | GTSVE | 690 | LTHTIGTSVEESEMF | 633 | 0 | 0 | 0 | 0 | 0 | 72 | 0 | 0 |
| YF | 5 | −1.05 | 264 | QTNGP | 691 | PGYKVQTNGPWMQVP | 634 | 0 | 0 | 0 | 0 | 0 | 72 | 0 | 0 |
| YF | 6 | −2.05 | 295 | RGKST | 692 | GNCDGRGKSTRSTTD | 635 | 0 | 0 | 0 | 0 | 0 | 71 | 0 | 0 |
| YF | 7 | −2.15 | 301 | STTDS | 693 | GKSTRSTTDSGKVIP | 636 | 0 | 0 | 0 | 0 | 0 | 72 | 0 | 0 |
| YF | 8 | −1.15 | 338 | PRKTH | 694 | PMEIRPRKTHESHLV | 637 | 0 | 0 | 0 | 0 | 0 | 50 | 0 | 0 |
| ZIKV | 1 | −1.55 | 14 | KETRC | 695 | VDFSKKETRCGTGVF | 638 | 0 | 0 | 0 | 0 | 0 | 0 | 47 | 0 |
| ZIKV | 2 | −1.62 | 38 | HPDSP | 696 | DRYKYHPDSPRRLAA | 639 | 0 | 0 | 0 | 0 | 0 | 0 | 47 | 0 |
| ZIKV | 3 | −1.06 | 130 | AKTNN | 697 | HFVRAAKTNNSFVVD | 640 | 0 | 0 | 0 | 0 | 0 | 0 | 47 | 0 |
| ZIKV | 4 | −1.23 | 193 | GKEAV | 698 | GTAVKGKEAVHSDLG | 641 | 0 | 0 | 0 | 0 | 0 | 0 | 44 | 0 |
| ZIKV | 5 | −1.23 | 209 | KNDTW | 699 | WIESEKNDTWRLKRA | 642 | 0 | 0 | 0 | 0 | 0 | 0 | 47 | 0 |
| ZIKV | 6 | −1.36 | 259 | TREGY | 700 | LSHHNTREGYRTQMK | 643 | 0 | 0 | 0 | 0 | 0 | 0 | 45 | 0 |
| ZIKV | 7 | −0.86 | 291 | EETCG | 701 | TKVHVEETCGTRGPS | 644 | 0 | 0 | 0 | 0 | 0 | 0 | 47 | 0 |
| ZIKV | 8 | −1.56 | 303 | STTAS | 702 | GPSLRSTTASGRVIE | 645 | 0 | 0 | 0 | 0 | 0 | 0 | 46 | 0 |
| ZIKV | 9 | −1.85 | 341 | RKEPE | 703 | MEIRPRKEPESNLVR | 646 | 0 | 0 | 0 | 0 | 0 | 0 | 46 | 0 |
| USUV | 1 | −1.05 | 37 | MPETP | 1231 | DRYKFMPETPKQLAK | 1299 | 0 | 0 | 0 | 0 | 0 | 0 | 0 | 65 |
| USUV | 2 | −1.07 | 95 | PKGMY | 1232 | VVVEKPKGMYKSAPQ | 1300 | 0 | 0 | 0 | 0 | 0 | 0 | 0 | 66 |
| USUV | 3 | −1.55 | 140 | PETKE | 1233 | FVVDGPETKECPDVK | 1301 | 0 | 0 | 0 | 0 | 51 | 0 | 0 | 68 |
| USUV | 4 | −1.44 | 176 | HNTTD | 1234 | LKVREHNTTDCDSSI | 1302 | 0 | 0 | 0 | 0 | 0 | 0 | 0 | 65 |
| USUV | 5 | −1.81 | 252 | PKSNH | 1235 | VTLAGPKSNHNRREG | 1303 | 0 | 0 | 0 | 0 | 0 | 0 | 0 | 67 |

TABLE 41-continued

NS1 peptides from USUV showing lack of cross reactivity with other flavivirus pentamers selected for a diagnostic array.

| Virus | # | Bepi Prob | Pos | Pent-ainer | SEQ ID NO.: | Flanking | SEQ ID NO.: | Den1 | Den2 | Den3 | Den4 | WNV | YF | ZIKV | USUV |
|---|---|---|---|---|---|---|---|---|---|---|---|---|---|---|---|
| USUV | 6 | −1.58 | 267 | QGPWD | 1236 | YKVQSQGPWDEEDIV | 1304 | 0 | 0 | 0 | 0 | 51 | 0 | 0 | 68 |
| USUV | 7 | −1.52 | 299 | SIRTT | 1237 | GKRGPSIRTTTSSGR | 1305 | 0 | 0 | 0 | 0 | 0 | 0 | 0 | 68 |
| USUV | 8 | −1.54 | 301 | RTTTS | 1238 | RGPSIRTTTSSGRLV | 1306 | 0 | 0 | 0 | 0 | 0 | 0 | 0 | 67 |

The selected USUV pentamers were then compared to various other potentially co-endemic pathogens, searching for the presence of the pentamers in these pathogens but not determining if they are present in B cell epitopes therein. Table 42 indicates where possible cross reactions may occur, particularly with other flaviviruses.

TABLE 42

| | SEQ ID NO.: | SLE | HEPC | JAEV | Parvo19 | Entero | Ross River | EEE | *Plasmodium falciparum* |
|---|---|---|---|---|---|---|---|---|---|
| Isolates tested | | 3 | 539 | 11 | 225 | 90 | 12 | 4 | 1 |
| Proteins | | 24 | 539 | 11 | 225 | 990 | 109 | 44 | 5392 |
| USUV peptide | | | | | | | | | |
| MPETP | 1231 | 0 | 0 | 0 | 0 | 0 | 0 | 0 | 0 |
| PKGMY | 1232 | 0 | 0 | 0 | 0 | 0 | 0 | 0 | 0 |
| PETKE | 1233 | 10 | 3 | 11 | 0 | 0 | 0 | 0 | 3 |
| HNTTD | 1234 | 0 | 0 | 0 | 0 | 0 | 0 | 0 | 1 |
| PKSNH | 1235 | 0 | 0 | 0 | 0 | 0 | 0 | 0 | 0 |
| QGPWD | 1236 | 0 | 0 | 11 | 0 | 0 | 0 | 0 | 0 |
| SIRTT | 1237 | 0 | 0 | 8 | 0 | 0 | 0 | 0 | 0 |
| RTTTS | 1238 | 0 | 0 | 0 | 0 | 0 | 0 | 0 | 4 |

REFERENCE LIST

[1] E.C.f.D.P.a. Control, Rapid risk assessment: Zika virus epidemic in the Americas: potential association with microcephaly and Guillain-Barré syndrome, Stockholm, December 2015.

[2] C.f.D. Control, Dengue Fact Sheet, 2006.

[3] S. B. Halstead, F. X. Heinz, A. D. Barrett, J. T. Roehrig, Dengue virus: molecular basis of cell entry and pathogenesis, 25-27 Jun. 2003, Vienna, Austria, Vaccine, 23 (2005) 849-856.

[4] C. Y. Lai, W. Y. Tsai, S. R. Lin, C. L. Kao, H. P. Hu, C. C. King, H. C. Wu, G. J. Chang, W. K. Wang, Antibodies to envelope glycoprotein of dengue virus during the natural course of infection are predominantly cross-reactive and recognize epitopes containing highly conserved residues at the fusion loop of domain II, J.Virol., 82 (2008) 6631-6643.

[5] R. C. Pinto, D. B. Castro, B. C. Albuquerque, S. Sampaio Vde, R. A. Passos, C. F. Costa, M. Sadahiro, J. U. Braga, Mortality Predictors in Patients with Severe Dengue in the State of Amazonas, Brazil, PloS one, 11 (2016) e0161884.

[6] P. R. Beatty, H. Puerta-Guardo, S. S. Killingbeck, D. R. Glasner, K. Hopkins, E. Harris, Dengue virus NS1 triggers endothelial permeability and vascular leak that is prevented by NS1 vaccination, Science translational medicine, 7 (2015) 304ra141.

[7] H. Puerta-Guardo, D. R. Glasner, E. Harris, Dengue Virus NS1 Disrupts the Endothelial Glycocalyx, Leading to Hyperpermeability, PLoS pathogens, 12 (2016) e1005738.

[8] S. J. Thomas, NS1: A corner piece in the dengue pathogenesis puzzle?, Science translational medicine, 7 (2015) 304fs337.

[9] U. Ashraf, J. Ye, X. Ruan, S. Wan, B. Zhu, S. Cao, Usutu virus: an emerging flavivirus in Europe, Viruses, 7 (2015) 219-238.

[10] A. E. Paniz-Mondolfi, W. E. Villamil-Gomez, A. J. Rodriguez-Morales, Usutu virus infection in Latin America: A new emerging threat, Travel Med Infect Dis, (2016).

[11] F. A. Rey, F. X. Heinz, C. Mandl, C. Kunz, S. C. Harrison, The envelope glycoprotein from tickborne encephalitis virus at 2 A resolution, Nature, 375 (1995) 291-298.

[12] V. C. Luca, J. AbiMansour, C. A. Nelson, D. H. Fremont, Crystal structure of the Japanese encephalitis virus envelope protein, Journal of virology, 86 (2012) 2337-2346.

[13] D. Gubler, Kuno G., Markoff L., Flaviviruses, in: D. Knipe, Howley, P M (Ed.) Field's Virology, Lippincott, Williams and Wilkins, Philadelphia, Pa., 2007, pp. 1153-1252.

[14] A. Santos-Carvalho, A. F. Ambrosio, C. Cavadas, Neuropeptide Y system in the retina: From localization to function, Progress in retinal and eye research, 47 (2015) 19-37.

[15] S. B. Halstead, Dengue Antibody-Dependent Enhancement: Knowns and Unknowns, Microbiology spectrum, 2 (2014).

[16] S. B. Halstead, S. Nimmannitya, S. N. Cohen, Observations related to pathogenesis of dengue hemorrhagic fever. IV. Relation of disease severity to antibody response and virus recovered, The Yale journal of biology and medicine, 42 (1970) 311-328.

[17] S. Porter, I. M. Clark, L. Kevorkian, D. R. Edwards, The ADAMTS metalloproteinases, Biochem J, 386 (2005) 15-27.

[18] A. D. Haddow, A. J. Schuh, C. Y. Yasuda, M. R. Kasper, V. Heang, R. Huy, H. Guzman, R. B. Tesh, S. C. Weaver, Genetic characterization of Zika virus strains: geographic expansion of the Asian lineage, PLoS neglected tropical diseases, 6 (2012) e1477.

[19] O. Faye, C. C. Freire, A. Iamarino, O. Faye, J. V. de Oliveira, M. Diallo, P. M. Zanotto, A. A. Sall, Molecular evolution of Zika virus during its emergence in the 20(th) century, PLoS neglected tropical diseases, 8 (2014) e2636.

[20] E. Oehler, L. Watrin, P. Larre, I. Leparc-Goffart, S. Lastere, F. Valour, L. Baudouin, H. Mallet, D. Musso, F. Ghawche, Zika virus infection complicated by Guillain-Barre syndrome—case report, French Polynesia, December 2013, Euro surveillance: bulletin europeen sur les maladies transmissibles=European communicable disease bulletin, 19 (2014).

[21] R. W. Malone, J. Homan, M. V. Callahan, J. Glasspool-Malone, L. Damodaran, B. Schneider Ade, R. Zimler, J. Talton, R. R. Cobb, I. Ruzic, J. Smith-Gagen, D. Janies, J. Wilson, G. Zika Response Working, Zika Virus: Medical Countermeasure Development Challenges, PLoS neglected tropical diseases, 10 (2016) e0004530.

[22] P. Brasil, J. P. Pereira, Jr., M. E. Moreira, R. M. Ribeiro Nogueira, L. Damasceno, M. Wakimoto, R. S. Rabello, S. G. Valderramos, U. A. Halai, T. S. Salles, A. A. Zin, D. Horovitz, P. Daltro, M. Boechat, C. Raja Gabaglia, P. Carvalho de Sequeira, J. H. Pilotto, R. Medialdea-Carrera, D. Cotrim da Cunha, L. M. Abreu de Carvalho, M. Pone, A. Machado Siqueira, G. A. Calvet, A. E. Rodrigues Baiao, E. S. Neves, P. R. Nassar de Carvalho, R. H. Hasue, P. B. Marschik, C. Einspieler, C. Janzen, J. D. Cherry, A. M. Bispo de Filippis, K. Nielsen-Saines, Zika Virus Infection in Pregnant Women in Rio de Janeiro, The New England journal of medicine, 375 (2016) 2321-2334.

[23] M. A. Honein, A. L. Dawson, E. E. Petersen, A. M. Jones, E. H. Lee, M. M. Yazdy, N. Ahmad, J. Macdonald, N. Evert, A. Bingham, S. R. Ellington, C. K. Shapiro-Mendoza, T. Oduyebo, A. D. Fine, C. M. Brown, J. N. Sommer, J. Gupta, P. Cavicchia, S. Slavinski, J. L. White, S. M. Owen, L. R. Petersen, C. Boyle, D. Meaney-Delman, D. J. Jamieson, U.S.Z.P.R. Collaboration, Birth Defects Among Fetuses and Infants of US Women With Evidence of Possible Zika Virus Infection During Pregnancy, JAMA, 317 (2017) 59-68.

[24] V.-M.B. Cao-Lormeau, A.; Mons, S.; Lastere, S.; Roche, C.; Vanhomwegan, J.; Dub, T.; Baudouin, L.; Teissier, A.; Larre, P.; Vial, A-L.; Decam, C.; Choumet, V.; Halstead, S. K.; Willison, H. J.; Musset, L.; Manuguerra, J-C.; Despres, P.; Fournier, E.; Mallet, H-P., Musso, D., Fontanet, A., Neil, J., Ghwache, F., Guillain-Barre Syndrome outbreak associated with Zika virus infection in French Polynesia: a case control study, Lancet, (2016).

[25] J. M. Anaya, Y. Rodriguez, D. M. Monsalve, D. Vega, E. Ojeda, D. Gonzalez-Bravo, M. Rodriguez-Jimenez, C. A. Pinto-Diaz, P. Chaparro, M. L. Gunturiz, A. A. Ansari, M. E. Gershwin, N. Molano-Gonzalez, C. Ramirez-Santana, Y. Acosta-Ampudia, A comprehensive analysis and immunobiology of autoimmune neurological syndromes during the Zika virus outbreak in Cucuta, Colombia, Journal of autoimmunity, (2017).

[26] E. Goncalves, Acute inflammatory demyelinating polyradiculoneuropathy (Guillain-Barre syndrome) following dengue fever, Revista do Instituto de Medicina Tropical de Sao Paulo, 53 (2011) 223-225.

[27] B. Roze, F. Najioullah, J. L. Ferge, K. Apetse, Y. Brouste, R. Cesaire, C. Fagour, L. Fagour, P. Hochedez, S. Jeannin, J. Joux, H. Mehdaoui, R. Valentino, A. Signate, A. Cabie, G.B.S.Z.W. Group, Zika virus detection in urine from patients with Guillain-Barre syndrome on Martinique, January 2016, Euro surveillance: bulletin europeen sur les maladies transmissibles=European communicable disease bulletin, 21 (2016).

[28] B. Roze, F. Najioullah, A. Signate, K. Apetse, Y. Brouste, S. Gourgoudou, L. Fagour, S. Abel, P. Hochedez, R. Cesaire, A. Cabie, M. Neuro-Zika Working Group of, Zika virus detection in cerebrospinal fluid from two patients with encephalopathy, Martinique, February 2016, Euro surveillance: bulletin europeen sur les maladies transmissibles=European communicable disease bulletin, 21 (2016).

[29] D. Butler, Brazil asks whether Zika acts alone to cause birth defects, Nature, 535 (2016) 475-476.

[30] L. P. De Goes Cavalcanti, P. L. Tauil, C. H. Alencar, W. Oliveira, M. M. Teixeira, J. Heukelbach, Zika virus infection, associated microcephaly, and low yellow fever vaccination coverage in Brazil: is there any causal link?, J Infect Dev Ctries, 10 (2016) 563-566.

[31] S. Bhatt, P. W. Gething, O. J. Brady, J. P. Messina, A. W. Farlow, C. L. Moyes, J. M. Drake, J. S. Brownstein, A. G. Hoen, O. Sankoh, M. F. Myers, D. B. George, T. Jaenisch, G. R. Wint, C. P. Simmons, T. W. Scott, J. J. Farrar, S. I. Hay, The global distribution and burden of dengue, Nature, 496 (2013) 504-507.

[32] D. H. Libraty, P. R. Young, D. Pickering, T. P. Endy, S. Kalayanarooj, S. Green, D. W. Vaughn, A. Nisalak, F. A. Ennis, A. L. Rothman, High circulating levels of the dengue virus nonstructural protein NS1 early in dengue illness correlate with the development of dengue hemorrhagic fever, J Infect Dis, 186 (2002) 1165-1168.

[33] C. V. Ventura, M. Maia, V. Bravo-Filho, A. L. Gois, R. Belfort, Jr., Zika virus in Brazil and macular atrophy in a child with microcephaly, Lancet, (2016).

[34] C. Kowal, A. Athanassiou, H. Chen, B. Diamond, Maternal antibodies and developing blood-brain barrier, Immunologic research, 63 (2015) 18-25.

[35] B. Diamond, P. T. Huerta, P. Mina-Osorio, C. Kowal, B. T. Volpe, Losing your nerves? Maybe it's the antibodies, Nature reviews. Immunology, 9 (2009) 449-456.

[36] E. Fox, D. Amaral, J. Van de Water, Maternal and fetal antibrain antibodies in development and disease, Developmental neurobiology, 72 (2012) 1327-1334.

[37] W. Dejnirattisai, P. Supasa, W. Wongwiwat, A. Rouvinski, G. Barba-Spaeth, T. Duangchinda, A. Sakuntabhai, V. M. Cao-Lormeau, P. Malasit, F. A. Rey, J. Mongkolsapaya, G. R. Screaton, Dengue virus sero-cross-reactivity drives antibody-dependent enhancement of infection with zika virus, Nat Immunol, (2016).
[38] O. Karimi, A. Goorhuis, J. Schinkel, J. Codrington, S. G. Vreden, J. S. Vermaat, C. Stijnis, M. P. Grobusch, Thrombocytopenia and subcutaneous bleedings in a patient with Zika virus infection, Lancet, (2016).
[39] T. M. Sharp, J. Munoz-Jordan, J. Perez-Padilla, M. I. Bello-Pagan, A. Rivera, D. M. Pastula, J. L. Salinas, J. H. Martinez Mendez, M. Mendez, A. M. Powers, S. Waterman, B. Rivera-Garcia, Zika Virus Infection Associated with Severe Thrombocytopenia, Clinical infectious diseases: an official publication of the Infectious Diseases Society of America, (2016).
[40] A. K. Falconar, The dengue virus nonstructural-1 protein (NS1) generates antibodies to common epitopes on human blood clotting, integrin/adhesin proteins and binds to human endothelial cells: potential implications in haemorrhagic fever pathogenesis, Arch.Virol., 142 (1997) 897-916.
[41] K. Djamiatun, A. J. van der Ven, P. G. de Groot, S. M. Faradz, D. Hapsari, W. M. Dolmans, S. Sebastian, R. Fijnheer, Q. de Mast, Severe dengue is associated with consumption of von Willebrand factor and its cleaving enzyme ADAMTS-13, PLoS neglected tropical diseases, 6 (2012) e1628.
[42] Y. C. Chuang, J. Lin, Y. S. Lin, S. Wang, T. M. Yeh, Dengue Virus Nonstructural Protein 1-Induced Antibodies Cross-React with Human Plasminogen and Enhance Its Activation, J Immunol, 196 (2016) 1218-1226.
[43] H. J. Cheng, Y. H. Luo, S. W. Wan, C. F. Lin, S. T. Wang, N. T. Hung, C. C. Liu, T. S. Ho, H. S. Liu, T. M. Yeh, Y. S. Lin, Correlation between serum levels of anti-endothelial cell autoantigen and anti-dengue virus nonstructural protein 1 antibodies in dengue patients, The American journal of tropical medicine and hygiene, 92 (2015) 989-995.
[44] E. Roberts, D. J. Hampshire, L. Pattison, K. Springell, H. Jafri, P. Corry, J. Mannon, Y. Rashid, Y. Crow, J. Bond, C. G. Woods, Autosomal recessive primary microcephaly: an analysis of locus heterogeneity and phenotypic variation, J Med Genet, 39 (2002) 718-721.
[45] C. Speake, A. Pichugin, T. Sahu, V. Malkov, R. Morrison, Y. Pei, L. Juompan, N. Milman, S. Zarling, C. Anderson, S. Wong-Madden, J. Wendler, A. Ishizuka, Z. W. MacMillen, V. Garcia, S. H. Kappe, U. Krzych, P. E. Duffy, Identification of Novel Pre-Erythrocytic Malaria Antigen Candidates for Combination Vaccines with Circumsporozoite Protein, PloS one, 11 (2016) e0159449.
[46] M. Van Esbroeck, K. Meersman, J. Michiels, K. K. Arien, D. Van den Bossche, Letter to the editor: Specificity of Zika virus ELISA: interference with malaria, Euro surveillance: bulletin europeen sur les maladies transmissibles=European communicable disease bulletin, 21 (2016).
[47] G. Robin, Y. Sato, D. Desplancq, N. Rochel, E. Weiss, P. Martineau, Restricted diversity of antigen binding residues of antibodies revealed by computational alanine scanning of 227 antibody-antigen complexes, J Mol Biol, 426 (2014) 3729-3743.
[48] H. Zhao, E. Fernandez, K. A. Dowd, S. D. Speer, D. J. Platt, M. J. Gorman, J. Govero, C. A. Nelson, T. C. Pierson, M. S. Diamond, D. H. Fremont, Structural Basis of Zika Virus-Specific Antibody Protection, Cell, (2016).
[49] R. D. Bremel, E. J. Homan, Frequency Patterns of T-Cell Exposed Amino Acid Motifs in Immunoglobulin Heavy Chain Peptides Presented by MHCs, Frontiers in immunology, 5 (2014) 541.
[50] A. Enfissi, J. Codrington, J. Roosblad, M. Kazanji, D. Rousset, Zika virus genome from the Americas, Lancet, (2016).
[51] K. Morl, A. G. Beck-Sickinger, Intracellular Trafficking of Neuropeptide Y Receptors, Progress in molecular biology and translational science, 132 (2015) 73-96.
[52] A. Santos-Carvalho, A. R. Alvaro, J. Martins, A. F. Ambrosio, C. Cavadas, Emerging novel roles of neuropeptide Y in the retina: from neuromodulation to neuroprotection, Prog Neurobiol, 112 (2014) 70-79.
[53] E. M. McNeill, M. Klockner-Bormann, E. C. Roesler, L. E. Talton, D. Moechars, M. Clagett-Dame, Nav2 hypomorphic mutant mice are ataxic and exhibit abnormalities in cerebellar development, Developmental biology, 353 (2011) 331-343.
[54] E. M. McNeill, K. P. Roos, D. Moechars, M. Clagett-Dame, Nav2 is necessary for cranial nerve development and blood pressure regulation, Neural development, 5 (2010) 6.
[55] M. Flamand, F. Megret, M. Mathieu, J. Lepault, F. A. Rey, V. Deubel, Dengue virus type 1 nonstructural glycoprotein NS1 is secreted from mammalian cells as a soluble hexamer in a glycosylation-dependent fashion, Journal of virology, 73 (1999) 6104-6110.
[56] P. R. Young, P. A. Hilditch, C. Bletchly, W. Halloran, An antigen capture enzyme-linked immunosorbent assay reveals high levels of the dengue virus protein NS1 in the sera of infected patients, Journal of clinical microbiology, 38 (2000) 1053-1057.
[57] S. Alcon-LePoder, P. Sivard, M. T. Drouet, A. Talarmin, C. Rice, M. Flamand, Secretion of flaviviral non-structural protein NS1: from diagnosis to pathogenesis, Novartis Found Symp, 277 (2006) 233-247; discussion 247-253.
[58] G. Kuno, A. V. Vorndam, D. J. Gubler, I. Gomez, Study of anti-dengue NS1 antibody by western blot, J.Med.Virol., 32 (1990) 102-108.
[59] I. J. Liu, C. Y. Chiu, Y. C. Chen, H. C. Wu, Molecular mimicry of human endothelial cell antigen by autoantibodies to nonstructural protein 1 of dengue virus, J Biol Chem, 286 (2011) 9726-9736.
[60] A. K. Falconar, The dengue virus nonstructural-1 protein (NS1) generates antibodies to common epitopes on human blood clotting, integrin/adhesin proteins and binds to human endothelial cells: potential implications in haemorrhagic fever pathogenesis, Archives of virology, 142 (1997) 897-916.
[61] M. A. Edeling, M. S. Diamond, D. H. Fremont, Structural basis of Flavivirus NS1 assembly and antibody recognition, Proc Natl Acad Sci USA, 111 (2014) 4285-4290.
[62] J. Bond, E. Roberts, G. H. Mochida, D. J. Hampshire, S. Scott, J. M. Askham, K. Springell, M. Mahadevan, Y. J. Crow, A. F. Markham, C. A. Walsh, C. G. Woods, ASPM is a major determinant of cerebral cortical size, Nat Genet, 32 (2002) 316-320.
[63] M. A. Rujano, L. Sanchez-Pulido, C. Pennetier, G. le Dez, R. Basto, The microcephaly protein Asp regulates neuroepithelium morphogenesis by controlling the spatial distribution of myosin II, Nat Cell Biol, 15 (2013) 1294-1306.
[64] N. Kouprina, A. Pavlicek, N. K. Collins, M. Nakano, V. N. Noskov, J. Ohzeki, G. H. Mochida, J. I. Risinger, P.

Goldsmith, M. Gunsior, G. Solomon, W. Gersch, J. H. Kim, J. C. Barrett, C. A. Walsh, J. Jurka, H. Masumoto, V. Larionov, The microcephaly ASPM gene is expressed in proliferating tissues and encodes for a mitotic spindle protein, Hum Mol Genet, 14 (2005) 2155-2165.

[65] C. C. Homem, M. Repic, J. A. Knoblich, Proliferation control in neural stem and progenitor cells, Nat Rev Neurosci, 16 (2015) 647-659.

[66] J. J. Schlesinger, M. W. Brandriss, E. E. Walsh, Protection of mice against dengue 2 virus encephalitis by immunization with the dengue 2 virus non-structural glycoprotein NS1, The Journal of general virology, 68 (Pt 3) (1987) 853-857.

[67] A. J. Goncalves, E. R. Oliveira, S. M. Costa, M. V. Paes, J. F. Silva, A. S. Azevedo, M. Mantuano-Barradas, A. C. Nogueira, C. J. Almeida, A. M. Alves, Cooperation between CD4+ T Cells and Humoral Immunity Is Critical for Protection against Dengue Using a DNA Vaccine Based on the NS1 Antigen, PLoS neglected tropical diseases, 9 (2015) e0004277.

[68] K. M. Chung, G. E. Nybakken, B. S. Thompson, M. J. Engle, A. Marri, D. H. Fremont, M. S. Diamond, Antibodies against West Nile Virus nonstructural protein NS1 prevent lethal infection through Fc gamma receptor-dependent and -independent mechanisms, J.Virol., 80 (2006) 1340-1351.

[69] E. J. M. Homan, R. W.; Darnell, S.; Bremel, R. D.; Antibody mediated epitope mimicry in the pathogenesis of Zika virus related disease, Preprint posted on BioRXiv, (2016).

[70] H. J. Rogers, C. Allen, A. E. Lichtin, Thrombotic thrombocytopenic purpura: The role of ADAMTS13, Cleveland Clinic journal of medicine, 83 (2016) 597-603.

[71] X. L. Zheng, ADAMTS13 and von Willebrand factor in thrombotic thrombocytopenic purpura, Annu Rev Med, 66 (2015) 211-225.

[72] D. B. Cines, V. S. Blanchette, Immune thrombocytopenic purpura, The New England journal of medicine, 346 (2002) 995-1008.

---

SEQUENCE LISTING (1336 sequences)

SEQ ID NO: 1 - protein, 5 aa, Zika virus
PVITE

SEQ ID NO: 2 - protein, 5 aa, Zika virus
EGAVH

SEQ ID NO: 3 - protein, 5 aa, Zika virus
STENS

SEQ ID NO: 4 - protein, 5 aa, Zika virus
PVITE

SEQ ID NO: 5 - protein, 5 aa, Zika virus
PVITE

SEQ ID NO: 6 - protein, 5 aa, Zika virus
PVITE

SEQ ID NO: 7 - protein, 5 aa, Zika virus
KGRLS

SEQ ID NO: 8 - protein, 5 aa, Zika virus
PVITE

SEQ ID NO: 9 - protein, 5 aa, Zika virus
PVITE

SEQ ID NO: 10 - protein, 5 aa, Zika virus
PVITE

SEQ ID NO: 11 - protein, 5 aa, Zika virus
PVITE

SEQ ID NO: 12 - protein, 5 aa, Zika virus
PVITE

SEQ ID NO: 13 - protein, 5 aa, Zika virus
AGADT

SEQ ID NO: 14 - protein, 5 aa, Zika virus
KGRLS

SEQ ID NO: 15 - protein, 5 aa, Zika virus
KGRLS

SEQ ID NO: 16 - protein, 5 aa, Zika virus
KGRLS

SEQ ID NO: 17 - protein, 5 aa, Zika virus
KGRLS

SEQ ID NO: 18 - protein, 5 aa, Zika virus
KGRLS

SEQ ID NO: 19 - protein, 5 aa, Zika virus
KGRLS

SEQ ID NO: 20 - protein, 5 aa, Zika virus
KGRLS

SEQ ID NO: 21 - protein, 5 aa, Zika virus
KGRLS

SEQ ID NO: 22 - protein, 5 aa, Zika virus
KGRLS

SEQ ID NO: 23 - protein, 5 aa, Zika virus
KGRLS

SEQ ID NO: 24 - protein, 5 aa, Zika virus
KGRLS

SEQ ID NO: 25 - protein, 5 aa, Zika virus
ATLGG

SEQ ID NO: 26 - protein, 5 aa, Zika virus
ATLGG

SEQ ID NO: 27 - protein, 5 aa, Zika virus
LSSGH

SEQ ID NO: 28 - protein, 5 aa, Zika virus
GGALN

SEQ ID NO: 29 - protein, 5 aa, Zika virus
QPENL

SEQ ID NO: 30 - protein, 5 aa, Zika virus
AGADT

SEQ ID NO: 31 - protein, 5 aa, Zika virus
ESTEN

SEQ ID NO: 32 - protein, 5 aa, Zika virus
AGTDG

SEQ ID NO: 33 - protein, 5 aa, Zika virus
ATLGG

SEQ ID NO: 34 - protein, 5 aa, Zika virus
RAEAT

SEQ ID NO: 35 - protein, 5 aa, Zika virus
AGADT

SEQ ID NO: 36 - protein, 5 aa, Zika virus
AGADT

SEQ ID NO: 37 - protein, 5 aa, Zika virus
DGSPC

SEQ ID NO: 38 - protein, 5 aa, Zika virus
GEDAP

SEQ ID NO: 39 - protein, 5 aa, Zika virus
GNETT

SEQ ID NO: 40 - protein, 5 aa, Zika virus
GNETT

SEQ ID NO: 41 - protein, 5 aa, Zika virus
GNETT

SEQ ID NO: 42 - protein, 5 aa, Zika virus
GNETT

SEQ ID NO: 43 - protein, 5 aa, Zika virus
GNETT

SEQ ID NO: 44 - protein, 5 aa, Zika virus
KCPST

SEQ ID NO: 45 - protein, 5 aa, Zika virus
KNPVD

SEQ ID NO: 46 - protein, 5 aa, Zika virus
KNPVD

SEQ ID NO: 47 - protein, 5 aa, Zika virus
KNPVD

SEQ ID NO: 48 - protein, 5 aa, Zika virus
KNPVD

SEQ ID NO: 49 - protein, 5 aa, Zika virus
KNPVD

SEQ ID NO: 50 - protein, 5 aa, Zika virus
LKGTT

SEQ ID NO: 51 - protein, 5 aa, Zika virus
STTLK

SEQ ID NO: 52 - protein, 5 aa, Zika virus
STTLK

SEQ ID NO: 53 - protein, 5 aa, Zika virus
STTLK

SEQ ID NO: 54 - protein, 5 aa, Zika virus
STTLK

SEQ ID NO: 55 - protein, 5 aa, Zika virus
STTLK

SEQ ID NO: 56 - protein, 5 aa, Zika virus
TDKEK

SEQ ID NO: 57 - protein, 5 aa, Zika virus
TDKEK

SEQ ID NO: 58 - protein, 5 aa, Zika virus
TDKEK

SEQ ID NO: 59 - protein, 5 aa, Zika virus
TDKEK

SEQ ID NO: 60 - protein, 5 aa, Zika virus
TDKEK

SEQ ID NO: 61 - protein, 5 aa, Zika virus
TDKEK

SEQ ID NO: 62 - protein, 5 aa, Zika virus
TDKEK

SEQ ID NO: 63 - protein, 5 aa, Zika virus
TDKEK

SEQ ID NO: 64 - protein, 5 aa, Zika virus
TDKEK

SEQ ID NO: 65 - protein, 5 aa, Zika virus
TDKEK

SEQ ID NO: 66 - protein, 5 aa, Zika virus
TDKEK

SEQ ID NO: 67 - protein, 5 aa, Zika virus
TDKEK

SEQ ID NO: 68 - protein, 5 aa, Zika virus
TPQAP

SEQ ID NO: 69 - protein, 5 aa, Zika virus
TPQAP

SEQ ID NO: 70 - protein, 5 aa, Zika virus
TPQAP

SEQ ID NO: 71 - protein, 5 aa, Zika virus
TPQAP

SEQ ID NO: 72 - protein, 5 aa, Zika virus
TPQAP

SEQ ID NO: 73 - protein, 5 aa, Zika virus
TPQAP

SEQ ID NO: 74 - protein, 5 aa, Zika virus
TPQAP

SEQ ID NO: 75 - protein, 5 aa, Zika virus
TPQAP

SEQ ID NO: 76 - protein, 5 aa, Zika virus
TPQAP

SEQ ID NO: 77 - protein, 5 aa, Zika virus
TPQAP

SEQ ID NO: 78 - protein, 5 aa, Zika virus
LAGAL

SEQ ID NO: 79 - protein, 5 aa, Zika virus
ALAGA

SEQ ID NO: 80 - protein, 5 aa, Zika virus
KKEAM

SEQ ID NO: 81 - protein, 5 aa, Zika virus
KKEAM

SEQ ID NO: 82 - protein, 5 aa, Zika virus
EAMEI

SEQ ID NO: 83 - protein, 5 aa, Zika virus
EAMEI

SEQ ID NO: 84 - protein, 5 aa, Zika virus
EAMEI

SEQ ID NO: 85 - protein, 5 aa, Zika virus
EAMEI

SEQ ID NO: 86 - protein, 5 aa, Zika virus
EAMEI

SEQ ID NO: 87 - protein, 5 aa, Zika virus
RKEKK

SEQ ID NO: 88 - protein, 5 aa, Zika virus
RKEKK

SEQ ID NO: 89 - protein, 5 aa, Zika virus
RKEKK

SEQ ID NO: 90 - protein, 5 aa, Zika virus
KEKKR

SEQ ID NO: 91 - protein, 5 aa, Zika virus
KEKKR

SEQ ID NO: 92 - protein, 5 aa, Zika virus
KEKKR

SEQ ID NO: 93 - protein, 5 aa, Zika virus
EKKRR

SEQ ID NO: 94 - protein, 5 aa, Zika virus
EKKRR

SEQ ID NO: 95 - protein, 5 aa, Zika virus
EKKRR

SEQ ID NO: 96 - protein, 5 aa, Zika virus
EKKRR

SEQ ID NO: 97 - protein, 5 aa, Zika virus
EKKRR

SEQ ID NO: 98 - protein, 5 aa, Zika virus
EKKRR

SEQ ID NO: 99 - protein, 5 aa, Zika virus
RRGAD

SEQ ID NO: 100 - protein, 5 aa, Zika virus
GADTS

SEQ ID NO: 101 - protein, 5 aa, Zika virus
GADTS

SEQ ID NO: 102 - protein, 5 aa, Zika virus
GADTS

SEQ ID NO: 103 - protein, 5 aa, Zika virus
GADTS

SEQ ID NO: 104 - protein, 5 aa, Zika virus
ADTSV

SEQ ID NO: 105 - protein, 5 aa, Zika virus
ADTSV

SEQ ID NO: 106 - protein, 5 aa, Zika virus
KKEAM

SEQ ID NO: 107 - protein, 5 aa, Zika virus
KKEAM

SEQ ID NO: 108 - protein, 5 aa, Zika virus
ARRSR

SEQ ID NO: 109 - protein, 5 aa, Zika virus
ARRSR

SEQ ID NO: 110 - protein, 5 aa, Zika virus
KLQTR

SEQ ID NO: 111 - protein, 5 aa, Zika virus
KLQTR

SEQ ID NO: 112 - protein, 5 aa, Zika virus
REYTK

SEQ ID NO: 113 - protein, 5 aa, Zika virus
REYTK

SEQ ID NO: 114 - protein, 5 aa, Zika virus
REYTK

SEQ ID NO: 115 - protein, 5 aa, Zika virus
REYTK

SEQ ID NO: 116 - protein, 5 aa, Zika virus
REYTK

SEQ ID NO: 117 - protein, 5 aa, Zika virus
REYTK

SEQ ID NO: 118 - protein, 5 aa, Zika virus
RKLQT

SEQ ID NO: 119 - protein, 5 aa, Zika virus
RKLQT

SEQ ID NO: 120 - protein, 5 aa, Zika virus
SHSTR

SEQ ID NO: 121 - protein, 5 aa, Zika virus
SHSTR

SEQ ID NO: 122 - protein, 5 aa, Zika virus
SHSTR

SEQ ID NO: 123 - protein, 5 aa, Zika virus
SHSTR

SEQ ID NO: 124 - protein, 5 aa, Zika virus
SHSTR

SEQ ID NO: 125 - protein, 5 aa, Zika virus
SHSTR

SEQ ID NO: 126 - protein, 5 aa, Zika virus
SHSTR

SEQ ID NO: 127 - protein, 5 aa, Zika virus
SHSTR

SEQ ID NO: 128 - protein, 5 aa, Zika virus
SHSTR

SEQ ID NO: 129 - protein, 5 aa, Zika virus
SHSTR

SEQ ID NO: 130 - protein, 5 aa, Zika virus
SHSTR

SEQ ID NO: 131 - protein, 5 aa, Zika virus
SHSTR

SEQ ID NO: 132 - protein, 5 aa, Zika virus
SHSTR

SEQ ID NO: 133 - protein, 5 aa, Zika virus
SHSTR

SEQ ID NO: 134 - protein, 5 aa, Zika virus
SHSTR

SEQ ID NO: 135 - protein, 5 aa, Zika virus
SHSTR

SEQ ID NO: 136 - protein, 5 aa, Zika virus
TLPSH

SEQ ID NO: 137 - protein, 5 aa, Zika virus
TLPSH

SEQ ID NO: 138 - protein, 5 aa, Zika virus
ARRSR

SEQ ID NO: 139 - protein, 5 aa, Zika virus
ARRSR

SEQ ID NO: 140 - protein, 5 aa, Zika virus
ARRSR

SEQ ID NO: 141 - DNA, 1332 bp, Zika virus
atggagacagacacactcctgctatgggtactgctgctctgggttccaggttccactggtgacacgcgtcatcaccatcaccatcacgactacaaggacgacgacgacaagcgctgtataggggtcagcaatagggatttcgttgagggcatgtccggtggaacatgggtggatatagtcctggaacatggagggtgcgttacagttatggctcaagataaacccaccgtagatattgaattggtgacaaccacagtgtctaacatggccgaagttcggagctattgttatgaagccagtatcagcgacatggcttccgattcacgctgcccaacccagggtgaagcctacttggataagcaaagcgatacacaatatgtctgcaagcgaaccctggtagatcgagggtgggggaatggctgcgggttgttcggcaagggatctctcgtcacatgcgccaaatttgcatgcagtaagaaaatgaccggaaaatccatacagcccgagaacctggaatatcggatcatgctctctgtccacggaagtcagcattccggtatgatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccaaggggcggctctcaagtggacaccttaagtgccgcctgaaaatggataagctgagattgaagggcgtatcttattccctgtgtacagccgcatttacttttactaagattcctgccgaaacccttcacgggacagtaactgtagaggtacagtacgcagggactgacggtccttgcaaagtacccgcacaaatggccgtagacatgcaaaccctcactcctgttgggcgactgatcaccgctaacccagttataactgagtccaccgaaaactccaaaatgatgcttgagttggaccctcctttcggtgacagttatatcgttataggcgtgggggaaaagaagattactcaccattggcaccgcagcggtagtactatctag

SEQ ID NO: 142 - protein, 443 aa, Zika virus
METDTLLLWVLLLWVPGSTGDTRHHHHHHDYKDDDDKRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTI

SEQ ID NO: 143 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagaactccaagatgatgctggagctggacccccccttcggcgactcctacatcgtgatcggcgtgggcgagaagaagatcacccaccactggcaccgctccggctccaccatctag

SEQ ID NO: 144 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTI

SEQ ID NO: 145 - DNA, 375 bp, Zika virus
atggagacagacacactcctgctatgggtactgctgctctgggttccaggttccactggtgacacgcgtcatcaccatcaccatcacgactacaaggacgacgacgacaagatctccgacatggcctccgactcccgctgccccacccagggcgaggcctacctggacaagcagtccgacacccagtacgtgtgcaagcgcaccctggtggaccgcggctggggcaacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatgtag

SEQ ID NO: 146 - protein, 124 aa, Zika virus
METDTLLLWVLLLWVPGSTGDTRHHHHHHDYKDDDDKISDMASDSRCPTQGEAYLDKQSDTQYVCKRTLVDRGWGNGCGLFGKGSLVTCAKFACSKKMTGKSIQPENLEYRIMLSVHGSQHSGM

SEQ ID NO: 147 - DNA, 339 bp, Zika virus
atggagacagacacactcctgctatgggtactgctgctctgggttccaggttccactggtgacacgcgtcatcaccatcaccatcacgactacaaggacgacgacgacaagatcgtgaacgacactggacacgagactgatgagaatcgagctaaggttgaaattactccaaactccccccgagctgaggctacactggggggattcggaagtcttgggcttgattgcgagccaagaaccgggcttgacttctcagacttgtactatctgacaatgaacaataagcattggcttgttcacaaggagtggttccacgatataccattgccttggcactag

SEQ ID NO: 148 - protein, 112 aa, Zika virus
METDTLLLWVLLLWVPGSTGDTRHHHHHHDYKDDDDKIVNDTGHETDENRAKVEITPNSPRAEATLGGFGSLGLDCEPRTGLDFSDLYYLTMNNKHWLVHKEWFHDIPLPWH

SEQ ID NO: 149 - DNA, 2016 bp, Zika virus
atggagacagacacactcctgctatgggtactgctgctctgggttccaggttccactggtgacacgcgtcgctgtataggggtcagcaatagggatttcgttgagggcatgtccggtggaacatgggtggatatagtcctggaacatggagggtgcgttacagttatggctcaagataaacccaccgtagatattgaattggtgacaaccacagtgtctaacatggccgaagttcggagctattgttatgaagccagtatcagcgacatggcttccgattcacgctgcccaacccagggtgaagcctacttggataagcaaagcgatacacaatatgtctgcaagcgaaccctggtagatcgagggtgggggaatggctgcgggttgttcggcaagggatctctcgtcacatgcgccaaatttgcatgcagtaagaaaatgaccggaaaatccatacagcccgagaacctggaatatcggatcatgctctctgtccacggaagtcagcattccggtatgatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccaaggggcggctctcaagtggacaccttaagtgccgcctgaaaatggataagctgagattgaagggcgtatcttattccctgtgtacagccgcatttacttttactaagattcctgccgaaacccttcacgggacagtaactgtagaggtacagtacgcagggactgacggtccttgcaaagtacccgcacaaatggccgtagacatgcaaaccctcactcctgttgggcgactgatcaccgctaacccagttataactgagtccaccgaaaactccaaaatgatgcttgagttggaccctcctttcggtgacagttatatcgttataggcgtgggggaaaagaagattactcaccattggcaccgcagcggtagtactatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 150 - protein, 671 aa, Zika virus
METDTLLLWVLLLWVPGSTGDTRRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 152 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - DNA, 1059 bp, Zika virus
atggagacagacacactcctgctatgggtactgctgctctgggttccaggttccactggtgacacgcgtatctccgacatggcctccgactcccgctgccccacccagggcgaggcctacctggacaagcagtccgacacccagtacgtgtgcaagcgcaccctggtggaccgcggctggggcaacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatggactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 154 - protein, 352 aa, Zika virus
METDTLLLWVLLLWVPGSTGDTRISDMASDSRCPTQGEAYLDKQSDTQYVCKRTLVDRGWGNGCGLFGKGSLVTCAKFACSKKMTGKSIQPENLEYRIMLSVHGSQHSGMDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - DNA, 1023 bp, Zika virus
atggagacagacacactcctgctatgggtactgctgctctgggttccaggttccactggtgacacgcgtatcgtgaacgacactggacacgagactgatgagaatcgagctaaggttgaaattactccaaactccccccgagctgaggctacactggggggattcggaagtcttgggcttgattgcgagccaagaaccgggcttgacttctcagacttgtactatctgacaatgaacaataagcattggcttgttcacaaggagtggttccacgatataccattgccttggcacgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 156 - protein, 340 aa, Zika virus
METDTLLLWVLLLWVPGSTGDTRIVNDTGHETDENRAKVEITPNSPRAEATLGGFGSLGLDCEPRTGLDFSDLYYLTMNNKHWLVHKEWFHDIPLPWHDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - DNA, 2037 bp, Zika virus
atggagacagacacactcctgctatgggtactgctgctctgggttccaggttccactggtgacacgcgtcatcaccatcaccatcaccgctgtataggggtcagcaatagggatttcgttgagggcatgtccggtggaacatgggtggatatagtcctggaacatggagggtgcgttacagttatggctcaagataaacccaccgtagatattgaattggtgacaaccacagtgtctaacatggccgaagttcggagctattgttatgaagccagtatcagcgacatggcttccgattcacgctgcccaacccagggtgaagcctacttggataagcaaagcgatacacaatatgtctgcaagcgaaccctggtagatcgagggtgggggaatggctgcgggttgttcggcaagggatctctcgtcacatgcgccaaatttgcatgcagtaagaaaatgaccggaaaatccatacagcccgagaacctggaatatcggatcatgctctctgtccacggaagtcagcattccggtatgatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccaaggggcggctctcaagtggacaccttaagtgccgcctgaaaatggataagctgagattgaagggcgtatcttattccctgtgtacagccgcatttacttttactaagattcctgccgaaacccttcacgggacagtaactgtagaggtacagtacgcagggactgacggtccttgcaaagtacccgcacaaatggccgtagacatgcaaaccctcactcctgttgggcgactgatcaccgctaacccagttataactgagtccaccgaaaactccaaaatgatgcttgagttggaccctcctttcggtgacagttatatcgttataggcgtgggggaaaagaagattactcaccattggcaccgcagcggtagtactatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 158 - protein, 678 aa, Zika virus
METDTLLLWVLLLWVPGSTGDTRHHHHHHRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 159 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 160 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 161 - DNA, 1080 bp, Zika virus
atggagacagacacactcctgctatgggtactgctgctctgggttccaggttccactggtgacacgcgtcatcaccatcaccatcacatctccgacatggcctccgactcccgctgccccacccagggcgaggcctacctggacaagcagtccgacacccagtacgtgtgcaagcgcaccctggtggaccgcggctggggcaacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatggactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 162 - protein, 359 aa, Zika virus
METDTLLLWVLLLWVPGSTGDTRHHHHHHISDMASDSRCPTQGEAYLDKQSDTQYVCKRTLVDRGWGNGCGLFGKGSLVTCAKFACSKKMTGKSIQPENLEYRIMLSVHGSQHSGMDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 163 - DNA, 1044 bp, Zika virus
atggagacagacacactcctgctatgggtactgctgctctgggttccaggttccactggtgacacgcgtcatcaccatcaccatcacatcgtgaacgacactggacacgagactgatgagaatcgagctaaggttgaaattactccaaactccccccgagctgaggctacactggggggattcggaagtcttgggcttgattgcgagccaagaaccgggcttgacttctcagacttgtactatctgacaatgaacaataagcattggcttgttcacaaggagtggttccacgatataccattgccttggcacgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 164 - protein, 347 aa, Zika virus
METDTLLLWVLLLWVPGSTGDTRHHHHHHIVNDTGHETDENRAKVEITPNSPRAEATLGGFGSLGLDCEPRTGLDFSDLYYLTMNNKHWLVHKEWFHDIPLPWHDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 165 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgataactccaagatgatgctggagctggacccccccttcggcgactcctacatcgtgatcggcgtgggcgagaagaagatcacccaccactggcaccgctccggctccaccatctag

SEQ ID NO: 166 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITDSTDNSKMMLELDPPFGDSYIVIGVGEKKITHHWHRSGSTI

SEQ ID NO: 167 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgataactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 168 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITDSTDNSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgataactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 170 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITDSTDNSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 171 - DNA, 216 bp, Zika virus
atggagacagacacactcctgctatgggtactgctgctctgggttccaggttccactggtgacacgcgtcatcaccatcaccatcacgactacaaggacgacgacgacaagggccgcctgatcaccgccaaccccgtgatcaccgagtccaccgagaactccaagatgatgctggagctggacccccccttcggcgactcctacatcggcgagtag

SEQ ID NO: 172 - protein, 71 aa, Zika virus
METDTLLLWVLLLWVPGSTGDTRHHHHHHDYKDDDDKGRLITANPVITESTENSKMMLELDPPFGDSYIGE

SEQ ID NO: 173 - DNA, 312 bp, Homo sapiens
atgctgggcaacaagcgcctgggcctgtccggcctgaccctggccctgtccctgctggtgtgcctgggcgccctggccgaggcccatcaccatcaccatcactacccctccaagcccgacaaccccggcgaggacgcccccgccgaggacatggcccgctactactccgccctgcgccactacatcaacctgatcacccgccagcgctacggcaagcgctcctcccccgagaccctgatctccgacctgctgatgcgcgagtccaccgagaacgtgccccgcacccgcctggaggaccccgccatgtggtag

SEQ ID NO: 174 - protein, 103 aa, Homo sapiens
MLGNKRLGLSGLTLALSLLVCLGALAEAHHHHHHYPSKPDNPGEDAPAEDMARYYSALRHYINLITRQRYGKRSSPETLISDLLMRESTENVPRTRLEDPAMW

SEQ ID NO: 175 - DNA, 312 bp, Homo sapiens
atgctgggcaacaagcgcctgggcctgtccggcctgaccctggccctgtccctgctggtgtgcctgggcgccctggccgaggcccatcaccatcaccatcactacccctccaagcccgacaacccccccgacgccgagggcgccgaggacatggcccgctactactccgccctgcgccactacatcaacctgatcacccgccagcgctacggcaagcgctcctcccccgagaccctgatctccgacctgctgatgcgcgagtccaccgagaacgtgccccgcacccgcctggaggaccccgccatgtggtag

SEQ ID NO: 176 - protein, 103 aa, Homo sapiens
MLGNKRLGLSGLTLALSLLVCLGALAEAHHHHHHYPSKPDNPPDAEGAEDMARYYSALRHYINLITRQRYGKRSSPETLISDLLMRESTENVPRTRLEDPAMW

SEQ ID NO: 177 - DNA, 312 bp, Homo sapiens
atgctgggcaacaagcgcctgggcctgtccggcctgaccctggccctgtccctgctggtgtgcctgggcgccctggccgaggcccatcaccatcaccatcactacccctccaagcccgacaaccccggcgaggacgcccccgccgaggacatggcccgctactactccgccctgcgccactacatcaacctgatcacccgccagcgctacggcaagcgctcctcccccgagaccctgatctccgacctgctgatgcgcaacacctccgaggaggtgccccgcacccgcctggaggaccccgccatgtggtag

SEQ ID NO: 178 - protein, 103 aa, Homo sapiens
MLGNKRLGLSGLTLALSLLVCLGALAEAHHHHHHYPSKPDNPGEDAPAEDMARYYSALRHYINLITRQRYGKRSSPETLISDLLMRNTSEEVPRTRLEDPAMW

SEQ ID NO: 179 - DNA, 312 bp, Homo sapiens
atgctgggcaacaagcgcctgggcctgtccggcctgaccctggccctgtccctgctggtgtgcctgggcgccctggccgaggcccatcaccatcaccatcactacccctccaagcccgacaacccccccgacgccgagggcgccgaggacatggcccgctactactccgccctgcgccactacatcaacctgatcacccgccagcgctacggcaagcgctcctcccccgagaccctgatctccgacctgctgatgcgctccaccaacgacgacgtgccccgcacccgcctggaggaccccgccatgtggtag

SEQ ID NO: 180 - protein, 103 aa, Homo sapiens
MLGNKRLGLSGLTLALSLLVCLGALAEAHHHHHHYPSKPDNPPDAEGAEDMARYYSALRHYINLITRQRYGKRSSPETLISDLLMRSTNDDVPRTRLEDPAMW

SEQ ID NO: 181 - DNA, 342 bp, Homo sapiens
atgctgggcaacaagcgcctgggcctgtccggcctgaccctggccctgtccctgctggtgtgcctgggcgccctggccgaggcccatcaccatcaccatcactacccctccaagcccgacaacccccccgacgccgagggcgccgaggacatggcccgctactactccgccctgcgccactacatcaacctgatcacccgccagcgctacggcaagcgctcctcccccgagaccctgatctccgacctgctgatgcgctccaaggacgtgcagctgaagaacatcaccgactacatgtacctggtgccccgcacccgcctggaggaccccgccatgtggtag

SEQ ID NO: 182 - protein, 113 aa, Homo sapiens
MLGNKRLGLSGLTLALSLLVCLGALAEAHHHHHHYPSKPDNPPDAEGAEDMARYYSALRHYINLITRQRYGKRSSPETLISDLLMRSKDVQLKNITDYMYLVPRTRLEDPAMW

SEQ ID NO: 183 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgacaactccaagatgatgctggagctggacccccccttcggcgactcctacatcgtgatcggcgtgggcgagaagaagatcacccaccactggcaccgctccggctccaccatctag

SEQ ID NO: 184 - protein, 142 aa, Zika virus; identical to SEQ ID NO: 166

SEQ ID NO: 185 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagacctccgagcagtccaagatgatgctggagctggacccccccttcggcgactcctacatcgtgatcggcgtgggcgagaagaagatcacccaccactggcaccgctccggctccaccatctag

SEQ ID NO: 186 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITETSEQSKMMLELDPPFGDSYIVIGVGEKKITHHWHRSGSTI

SEQ ID NO: 187 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaagtccaccgagaactccaagatgatgctggagctggacccccccttcggcgactcctacatcgtgatcggcgtgggcgagaagaagatcacccaccactggcaccgctccggctccaccatctag

SEQ ID NO: 188 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITKSTENSKMMLELDPPFGDSYIVIGVGEKKITHHWHRSGSTI

SEQ ID NO: 189 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaactccaccgaggagtccaagatgatgctggagctggacccccccttcggcgactcctacatcgtgatcggcgtgggcgagaagaagatcacccaccactggcaccgctccggctccaccatctag

SEQ ID NO: 190 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITNSTEESKMMLELDPPFGDSYIVIGVGEKKITHHWHRSGSTI

SEQ ID NO: 191 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgagaactccaagatgatgctggagctggacccccccttcggcgactcctacatcgtgatcggcgtgggcgagaagaagatcacccaccactggcaccgctccggctccaccatctag

SEQ ID NO: 192 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITDSTENSKMMLELDPPFGDSYIVIGVGEKKITHHWHRSGSTI

SEQ ID NO: 193 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagcagtccaagatgatgctggagctggacccccccttcggcgactcctacatcgtgatcggcgtgggcgagaagaagatcacccaccactggcaccgctccggctccaccatctag

SEQ ID NO: 194 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITESTEQSKMMLELDPPFGDSYIVIGVGEKKITHHWHRSGSTI

SEQ ID NO: 195 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagacctccgagaactccaagatgatgctggagctggacccccccttcggcgactcctacatcgtgatcggcgtgggcgagaagaagatcacccaccactggcaccgctccggctccaccatctag

SEQ ID NO: 196 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITETSENSKMMLELDPPFGDSYIVIGVGEKKITHHWHRSGSTI

SEQ ID NO: 197 - DNA, 429 bp, Zika virus
atggagacagacacactcctgctatgggtactgctgctctgggttccaggttccactggtgacacgcgtcatcaccatcaccatcacgactacaaggacgacgacgacaaggtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcacccgctccaccgagaactccaagatgatgctggagctggacccccccttcggcgactcctacatcgtgatcggcgtgggcgagaagaagatcacccaccactggcaccgctccggctccaccatctag

SEQ ID NO: 198 - protein, 142 aa, Zika virus
METDTLLLWVLLLWVPGSTGDTRHHHHHHDYKDDDDKVSYSLCTAAFTFTKIPAETLHGTVTVEVQYAGTDGPCKVPAQMAVDMQTLTPVGRLITANPVITRSTENSKMMLELDPPFGDSYIVIGVGEKKITHHWHRSGSTI

SEQ ID NO: 199 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgacaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 200 - protein, 370 aa, Zika virus; identical to SEQ ID NO: 168

SEQ ID NO: 201 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 202 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITDSTENSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagcagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 204 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITESTEQSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagacctccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 206 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITETSENSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagacctccgagcagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 208 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITETSEQSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaagtccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 210 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITKSTENSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaactccaccgaggagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 212 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITNSTEESKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - DNA, 1113 bp, Zika virus
atggagacagacacactcctgctatgggtactgctgctctgggttccaggttccactggtgacacgcgtgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcacccgctccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 214 - protein, 370 aa, Zika virus
METDTLLLWVLLLWVPGSTGDTRVSYSLCTAAFTFTKIPAETLHGTVTVEVQYAGTDGPCKVPAQMAVDMQTLTPVGRLITANPVITRSTENSKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgacaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 216 - protein, 377 aa, Zika virus; identical to SEQ ID NO: 170

SEQ ID NO: 217 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgactccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 218 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITDSTENSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 219 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagcagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 220 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITESTEQSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 221 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagacctccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 222 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITETSENSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 223 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagacctccgagcagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 224 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITETSEQSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 225 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaagtccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 226 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITKSTENSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 227 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaactccaccgaggagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 228 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITNSTEESKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 229 - DNA, 1134 bp, Zika virus
atggagacagacacactcctgctatgggtactgctgctctgggttccaggttccactggtgacacgcgtcatcaccatcaccatcacgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcacccgctccaccgagaactccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 230 - protein, 377 aa, Zika virus
METDTLLLWVLLLWVPGSTGDTRHHHHHHVSYSLCTAAFTFTKIPAETLHGTVTVEVQYAGTDGPCKVPAQMAVDMQTLTPVGRLITANPVITRSTENSKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 231 - DNA, 324 bp, Zika virus
atgctgggcaacaagcgcctgggcctgtccggcctgaccctggccctgtccctgctggtgtgcctgggcgccctggccgaggcccatcaccatcaccatcactacccctccaagcccgacaacccccccgacgccgagggcgccgaggacatggcccgctactactccgccctgcgccactacatcaacctgatcacccgccagcgctacggcaagcgctcctcccccgagaccctgatctccgacctgctgatgcgcggctccaccggctactccaccgcccccgtgccccgcacccgcctggaggaccccgccatgtggtag

SEQ ID NO: 232 - protein, 107 aa, Zika virus
MLGNKRLGLSGLTLALSLLVCLGALAEAHHHHHHYPSKPDNPPDAEGAEDMARYYSALRHYINLITRQRYGKRSSPETLISDLLMRGSTGYSTAPVPRTRLEDPAMW

SEQ ID NO: 233 - DNA, 324 bp, Zika virus
atgctgggcaacaagcgcctgggcctgtccggcctgaccctggccctgtccctgctggtgtgcctgggcgccctggccgaggcccatcaccatcaccatcactacccctccaagcccgacaacccccccgacgccgagggcgccgaggacatggcccgctactactccgccctgcgccactacatcaacctgatcacccgccagcgctacggcaagcgctcctcccccgagaccctgatctccgacctgctgatgcgcgtgatgaagcaggacggccacgtgatggtgccccgcacccgcctggaggaccccgccatgtggtag

SEQ ID NO: 234 - protein, 107 aa, Zika virus
MLGNKRLGLSGLTLALSLLVCLGALAEAHHHHHHYPSKPDNPPDAEGAEDMARYYSALRHYINLITRQRYGKRSSPETLISDLLMRVMKQDGHVMVPRTRLEDPAMW

SEQ ID NO: 235 - DNA, 810 bp, Homo sapiens
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagaagggccgcctgtcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccagaccgacaaggagaagggcatctcctccgacaacgagtccgtggcctcctgcaactccgtgaaggtgaaccccgccgcccagcccgtgtcctcccccgcccagacctcctag

SEQ ID NO: 236 - protein, 269 aa, Homo sapiens
METDTLLLWVLLLWVPGSTGDTRHHHHHHVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTS

SEQ ID NO: 237 - DNA, 810 bp, Homo sapiens
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagctgcgcaagggctcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccagaccgacaaggagaagggcatctcctccgacaacgagtccgtggcctcctgcaactccgtgaaggtgaaccccgccgcccagcccgtgtcctcccccgcccagacctcctag

SEQ ID NO: 238 - protein, 269 aa, Homo sapiens
METDTLLLWVLLLWVPGSTGDTRHHHHHHVGITMPRTKPSAPAGALKTPGTGKTDDAKVSELRKGSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTS

SEQ ID NO: 239 - DNA, 810 bp, Homo sapiens
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagaagggccgcctgtcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctcctag

SEQ ID NO: 240 - protein, 269 aa, Homo sapiens
METDTLLLWVLLLWVPGSTGDTRHHHHHHVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTS

SEQ ID NO: 241 - DNA, 810 bp, Homo sapiens
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagtccaccaacgacgaccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctcctag

SEQ ID NO: 242 - protein, 269 aa, Homo sapiens
METDTLLLWVLLLWVPGSTGDTRHHHHHHVGITMPRTKPSAPAGALKTPGTGKTDDAKVSESTNDDPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTS

SEQ ID NO: 243 - DNA, 840 bp, Homo sapiens
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagtccaaggacgtgcagctgaagaacatcaccgactacatgtacctgcccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctcctag

SEQ ID NO: 244 - protein, 279 aa, Homo sapiens
METDTLLLWVLLLWVPGSTGDTRHHHHHHVGITMPRTKPSAPAGALKTPGTGKTDDAKVSESKDVQLKNITDYMYLPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTS

SEQ ID NO: 245 - DNA, 567 bp, Zika virus
atggagacagacacactcctgctatgggtactgctgctctgggttccaggttccactggtgacacgcgtcatcaccatcaccatcacgactacaaggacgacgacgacaagatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccctgcgcaagggctccagtggacaccttaagtgccgcctgaaaatggataagctgagattgaagggctag

SEQ ID NO: 246 - protein, 188 aa, Zika virus
METDTLLLWVLLLWVPGSTGDTRHHHHHHDYKDDDDKIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGALRKGSSGHLKCRLKMDKLRLKG

SEQ ID NO: 247 - DNA, 567 bp, Zika virus
atggagacagacacactcctgctatgggtactgctgctctgggttccaggttccactggtgacacgcgtcatcaccatcaccatcacgactacaaggacgacgacgacaagatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagcccgcaagggcctgtccagtggacaccttaagtgccgcctgaaaatggataagctgagattgaagggctag

SEQ ID NO: 248 - protein, 188 aa, Zika virus
METDTLLLWVLLLWVPGSTGDTRHHHHHHDYKDDDDKIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGARKGLSSGHLKCRLKMDKLRLKG

SEQ ID NO: 249 - DNA, 567 bp, Zika virus
atggagacagacacactcctgctatgggtactgctgctctgggttccaggttccactggtgacacgcgtcatcaccatcaccatcacgactacaaggacgacgacgacaagatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccaagggccgcatcaccagtggacaccttaagtgccgcctgaaaatggataagctgagattgaagggctag

SEQ ID NO: 250 - protein, 188 aa, Zika virus
METDTLLLWVLLLWVPGSTGDTRHHHHHHDYKDDDDKIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRITSGHLKCRLKMDKLRLKG

SEQ ID NO: 251 - DNA, 567 bp, Zika virus
atggagacagacacactcctgctatgggtactgctgctctgggttccaggttccactggtgacacgcgtcatcaccatcaccatcacgactacaaggacgacgacgacaagatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccggcctgtccaagcgcagtggacaccttaagtgccgcctgaaaatggataagctgagattgaagggctag

SEQ ID NO: 252 - protein, 188 aa, Zika virus
METDTLLLWVLLLWVPGSTGDTRHHHHHHDYKDDDDKIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAGLSKRSGHLKCRLKMDKLRLKG

SEQ ID NO: 253 - DNA, 1332 bp, Zika virus
atggagacagacacactcctgctatgggtactgctgctctgggttccaggttccactggtgacacgcgtcatcaccatcaccatcacgactacaaggacgacgacgacaagcgctgtataggggtcagcaatagggatttcgttgagggcatgtccggtggaacatgggtggatatagtcctggaacatggagggtgcgttacagttatggctcaagataaacccaccgtagatattgaattggtgacaaccacagtgtctaacatggccgaagttcggagctattgttatgaagccagtatcagcgacatggcttccgattcacgctgcccaacccagggtgaagcctacttggataagcaaagcgatacacaatatgtctgcaagcgaaccctggtaaacggctggggccgcgacggctgcgggttgttcggcaagggatctctcgtcacatgcgccaaatttgcatgcagtaagaaaatgaccggaaaatccatacagcccgagaacctggaatatcggatcatgctctctgtccacggaagtcagcattccggtatgatcgtgaatgacaccgggcatgagaccgacgaaaacagggccaaagtcgagattacccccaattctccccgcgcagaggcaaccctcggaggatttggaagcctgggactggactgtgaaccaaggactggactcgacttcagcgacctctattatctcacaatgaataataagcactggcttgtacataaagaatggtttcacgacattcctcttccctggcacgccggggccgacacaggaacaccacactggaataacaaagaagctcttgtggagttcaaagacgctcacgcaaagcgccaaaccgtagtggtgctgggcagccaagaaggagccgttcacacagccttggctggggcattggaggctgaaatggacggagccctgcgcaagggctccagtggacaccttaagtgccgcctgaaaatggataagctgagattgaagggcgtatcttattccctgtgtacagccgcatttacttttactaagattcctgccgaaacccttcacgggacagtaactgtagaggtacagtacgcagggactgacggtccttgcaaagtacccgcacaaatggccgtagacatgcaaaccctcactcctgttgggcgactgatcaccgctaacccagttataactaacacctccgaggagtccaaaatgatgcttgagttggaccctcctttcggtgacagttatatcgttataggcgtgggggaaaagaagattactcaccattggcaccgcagcggtagtactatctag

SEQ ID NO: 254 - protein, 443 aa, Zika virus
METDTLLLWVLLLWVPGSTGDTRHHHHHHDYKDDDDKRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVNGWGRDGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGALRKGSSGHLKCRLKMDKLRLKGVSYSLCTAAFTFTKIPAETLHGTVTVEVQYAGTDGPCKVPAQMAVDMQTLTPVGRLITANPVITNTSEESKMMLELDPPFGDSYIVIGVGEKKITHHWHRSGSTI

SEQ ID NO: 255 - protein, 5 aa, Zika virus
PRAEA

SEQ ID NO: 256 - protein, 5 aa, Zika virus
MSGGT

SEQ ID NO: 257 - DNA, 1812 bp, Zika virus
atgggcaagcgctccgccggctccatcatgtggctggcctccctggccgtggtgatcgcctgcgccggcgccgccgtgaccctgccctcccactccacccgcaagctgcagacccgctcccagacctggctggagtcccgcgagtacaccaagcacctgatccgcgtggagaactggatcttccgcaaccccggcttcgccctggccgccgccgccatcgcctggctgctgggctcctccacctcccagaaggtgatctacctggtgatgatcctgctgatcgcccccgcctactccatccgctgcatcggcgtgtccaaccgcgacttcgtggagggcatgtccggcggcacctgggtggacgtggtgctggagcacggcggctgcgtgaccgtgatggcccaggacaagcccaccgtggacatcgagctggtgaccaccaccgtgtccaacatggccgaggtgcgctcctactgctacgaggcctccatctccgacatggcctccgactcccgctgccccacccagggcgaggcctacctggacaagcagtccgacacccagtacgtgtgcaagcgcaccctggtgaatggctggggccgcgacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatgatcgtgaacgacaccggccacgagaccgacgagaaccgcgccaaggtggagatcacccccaactccccccgcgccgaggccaccctgggcggcttcggctccctgggcctggactgcgagccccgcaccggcctggacttctccgacctgtactacctgaccatgaacaacaagcactggctggtgcacaaggagtggttccacgacatccccctgccctggcacgccggcgccgacaccggcaccccccactggaacaacaaggaggccctggtggagttcaaggacgcccacgccaagcgccagaccgtggtggtgctgggctcccaggagggcgccgtgcacaccgccctggccggcgccctggaggccgagatggacggcgccaagggccgcctgtcctccggccacctgaagtgccgcctgaagatggacaagctgcgcctgaagggcgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccgagtccaccgagaactccaagatgatgctggagctggacccccccttcggcgactcctacatcgtgatcggcgtgggcgagaagaagatcacccaccactggcaccgctccggctccaccatcggcaaggccttcgaggccaccgtgcgcggcgccaagcgcatggccgtgctgggcgacaccgcctgggacttcggctccgtgggcggcgccctgaactccctgggcaagggcatccaccagatcttcggcgccgccttcaagtccctgttcggcggcatgtcctggttctcccagatcctgatcggcaccctgctgatgtggctgggcctgaacaccaagaacggctccatctccctgatgtgcctggccctgggcggcgtgctgatcttcctgtccaccgccgtgtccgcctag

SEQ ID NO: 258 - protein, 603 aa, Zika virus
MGKRSAGSIMWLASLAVVIACAGAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVNGWGRDGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 259 - DNA, 1812 bp, Zika virus
atgggaaaaaggagtgctggctcaattatgtggctcgccagtctcgccgtagtcatagcttgcgccggggccgccgtgaccctccccagtcattcaactcgcaaacttcaaacacgaagtcaaacatggcttgagtcaagagaatacacgaagcacctcatccgcgtggaaaactggatattccgcaatccgggattcgcgctcgccgcagccgctattgcgtggcttctcgggagttctaccagccagaaggtcatttacttggtaatgatattgctcatcgcacccgcatactctatccgatgtataggggttagtaatcgggactttgttgagggaatgtcaggcgggacatgggtagatgtggtcctcgaacatggcggatgcgtcaccgtcatggcacaagacaagcctactgttgatatagagctggtgactaccactgtctccaatatggcagaagtccgatcctattgttacgaagcctccatatcagacatggcgagcgacagtagatgtccaacccagggtgaggcctacttggataagcagagtgatactcaatacgtttgcaaacgcactctggttgacaggggatggggaaacggatgcggactctttggcaagggaagtctggtcacttgcgcgaagttcgcctgttcaaaaaagatgaccggcaaaagcattcagccagaaaatttggaatacagaataatgttgtccgttcacggctcacaacacagcggcatgattgtcaacgatacgggtcatgagacggacgaaaacagggccaaagtcgagataacgcccaatagcccagaggcaagggctacattgggagggttcggctctttgggactcgactgtgaaccaagaaccggattggatttcagcgacctgtactatctgacgatgaataataaacactggttggtccacaaagaatggttccatgacatccccctgccctggcatgcaggcgagaaagcgcccaccccccactggaacaacaaggaggccttggtcgagtttaaggacgcgcacgcgaagaggcagacggtggtggtcctcggctcccaagagggggccgtgcatacagctcttgcaggagccctcgaagccgagatggacggagcactccgaaaaggatcctctgggcaccttaagtgtcgcctgaaaatggataagctccgactcaaaggtgtaagttactccctgtgtacggcagccttcaccttcacgaaaatacccgcggaaacgctccacggaaccgttacggttgaagtccagtacgccggcacggatggtccgtgtaaagtcccggctcagatggctgttgatatgcaaacccttactcccgtcggacggctcataacggctaacccggttattacgaacacgtctgaggaaagcaagatgatgctggaactcgacccaccgttcggtgactcctacatagtgataggagtaggagagaagaaaatcacccatcattggcaccgcagcggatcaaccataggtaaagcttttgaggccaccgtacgaggagcaaagcgaatggccgtgctgggagacaccgcctgggactttggctctgtagggggcgctctcaattccttgggcaaggggatacatcagatattcggggcagcatttaaatctctgtttggtggtatgagttggttttcccagattttgattgggactttgctgatgtggctcggtcttaataccaaaaacggctcaattagtctcatgtgtctcgctttgggaggagtcctcatattcctttccacagccgtatccgcatga

SEQ ID NO: 260 - protein, 603 aa, Zika virus
MGKRSAGSIMWLASLAVVIACAGAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPEARATLGGFGSLGLDCEPRTGLDFSDLYYLTMNNKHWLVHKEWFHDIPLPWHAGEKAPTPHWNNKEALVEFKDAHAKRQTVVVLGSQEGAVHTALAGALEAEMDGALRKGSSGHLKCRLKMDKLRLKGVSYSLCTAAFTFTKIPAETLHGTVTVEVQYAGTDGPCKVPAQMAVDMQTLTPVGRLITANPVITNTSEESKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 261 - DNA, 1812 bp, Zika virus
atggggaagcggtccgcgggatcaataatgtggcttgccagtctcgcagtagtgatcgcctgcgccggtgcagcagtcacacttccttcacattcaacgagaaaactgcagactagatcacaaacctggcttgagtccagggaatacacgaagcacctcataagagtggaaaattggatattccgcaaccccggctttgcgcttgcggctgctgctatcgcatggctgctgggctcttccaccagtcaaaaagtgatttacctggtgatgatcctcttgattgccccggcatattcaattcggtgcattggtgtcagcaaccgagactttgtagaaggcatgtcagggggcacgtgggttgacgttgtacttgaacacggtgggtgcgtcacagtgatggcccaagataagccaaccgtggacattgaactggtgactacaacggtttcaaatatggccgaggtacgctcctattgttacgaggcatctatatccgatatggcgtcagattcccggtgtccgacacaaggcgaagcgtaccttgataaacaatctgatacccagtacgtgtgtaaacgcacgcttgttgaccgcggttggggaaacggctgtggactcttcggaaaaggctcattggttacttgcgctaaatttgcttgttcaaaaaaaatgacagggaaatcaatacaaccggagaatttggagtaccgcatcatgctgtctgtacatggatctcaacacagcgggatgatagtcaacgacactggacatgagactgatgaaaacagggcaaaggtcgaaataactcccaattcacctagggccgaagccacactgggaggatttggctctctggggctggattgcgaaccaaggacaggactcgacttcagtgacctctactacttgacaatgaacaataagcactggctggttcacaaggagtggttccatgatattccccttccgtggcatgctggagccgatacgggaaccccccattggaacaacaaagaagcgttggtggaattcaaagatgcgcacgcgaaacgacaaacagtcgtggtgctcgggagtcaggaaggggccgtgcacacggctttggccggcgcattggaggcggagatggacggagccaaaggaaggctctccagtgggcatttgaaatgtagattgaaaatggataaacttcggctgaaaggggtgagttatagtctctgtactgctgcgtttacgtttacaaagattcctgcggagacacttcatggtaccgtgaccgtagaagtacagtacgcgggcacagacggcccttgtaaggttcccgctcagatggcggtggatatgcagacattgacgcctgttggtagactcattactgcgaatccggtaattactgagtcaacagagaattccaaaatgatgctcgaactcgaccctccgttcggagactcttacattgttattggagtgggtgaaaagaagatcacccatcattggcataggtctggctctaccataggcaaagctttcgaggccacagttcgcggagctaagcgaatggcagtccttggtgatactgcatgggatttcggctcagtagggggggcactgaactccttgggaaaaggcatccatcaaattttcggggcagcattcaaatccctgttcgggggcatgtcttggtttagccaaatcttgatcggtacgctgctgatgtggctcgggcttaacactaagaacggctccattagtttgatgtgtcttgctttgggtggtgttcttatttttttgtccaccgccgtttctgcttag

SEQ ID NO: 262 - protein, 603 aa, Zika virus
MGKRSAGSIMWLASLAVVIACAGAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 263 - protein, 5 aa, Yellow fever virus
AEENE

SEQ ID NO: 264 - protein, 5 aa, Yellow fever virus
ASTND

SEQ ID NO: 265 - protein, 5 aa, Yellow fever virus
CPSTG

SEQ ID NO: 266 - protein, 5 aa, Yellow fever virus
DKCPS

SEQ ID NO: 267 - protein, 5 aa, Yellow fever virus
DTGHG

SEQ ID NO: 268 - protein, 5 aa, Yellow fever virus
DTNDN

SEQ ID NO: 269 - protein, 5 aa, Yellow fever virus
EENEG

SEQ ID NO: 270 - protein, 5 aa, Yellow fever virus
EGDNA

SEQ ID NO: 271 - protein, 5 aa, Yellow fever virus
ENEGD

SEQ ID NO: 272 - protein, 5 aa, Yellow fever virus
IASTN

SEQ ID NO: 273 - protein, 5 aa, Yellow fever virus
KCPST

SEQ ID NO: 274 - protein, 5 aa, Yellow fever virus
KDTND

SEQ ID NO: 275 - protein, 5 aa, Yellow fever virus
NEGDN

SEQ ID NO: 276 - protein, 5 aa, Yellow fever virus
NPTDT

SEQ ID NO: 277 - protein, 5 aa, Yellow fever virus
NQEGS

SEQ ID NO: 278 - protein, 5 aa, Yellow fever virus
PSTGE

SEQ ID NO: 279 - protein, 5 aa, Yellow fever virus
PTDTG

SEQ ID NO: 280 - protein, 5 aa, Yellow fever virus
QEGSL

SEQ ID NO: 281 - protein, 5 aa, Yellow fever virus
TDTGH

SEQ ID NO: 282 - protein, 5 aa, Yellow fever virus
TKDTN

SEQ ID NO: 283 - protein, 5 aa, Dengue virus
ASTSQ

SEQ ID NO: 284 - protein, 5 aa, Dengue virus
DEKGV

SEQ ID NO: 285 - protein, 5 aa, Dengue virus
EGTDA

SEQ ID NO: 286 - protein, 5 aa, Dengue virus
EIQTS

SEQ ID NO: 287 - protein, 5 aa, Dengue virus
EKGVT

SEQ ID NO: 288 - protein, 5 aa, Dengue virus
ETTEH

SEQ ID NO: 289 - protein, 5 aa, Dengue virus
GASTS

SEQ ID NO: 290 - protein, 5 aa, Dengue virus
GNETT

SEQ ID NO: 291 - protein, 5 aa, Dengue virus
GVTQN

SEQ ID NO: 292 - protein, 5 aa, Dengue virus
IQTSG

SEQ ID NO: 293 - protein, 5 aa, Dengue virus
ISNTT

SEQ ID NO: 294 - protein, 5 aa, Dengue virus
KGVTQ

SEQ ID NO: 295 - protein, 5 aa, Dengue virus
NETTE

SEQ ID NO: 296 - protein, 5 aa, Dengue virus
NTTTD

SEQ ID NO: 297 - protein, 5 aa, Dengue virus
QTSGT

SEQ ID NO: 298 - protein, 5 aa, Dengue virus
SGAST

SEQ ID NO: 299 - protein, 5 aa, Dengue virus
SNTTT

SEQ ID NO: 300 - protein, 5 aa, Dengue virus
SQETW

SEQ ID NO: 301 - protein, 5 aa, Dengue virus
STSQE

SEQ ID NO: 302 - protein, 5 aa, Dengue virus
TEPPF

SEQ ID NO: 303 - protein, 5 aa, Dengue virus
TPQAP

SEQ ID NO: 304 - protein, 5 aa, Dengue virus
TSQET

SEQ ID NO: 305 - protein, 5 aa, Dengue virus
TTTDS

SEQ ID NO: 306 - protein, 5 aa, Dengue virus
ADTQG

SEQ ID NO: 307 - protein, 5 aa, Dengue virus
DTGKH

SEQ ID NO: 308 - protein, 5 aa, Dengue virus
DTQGS

SEQ ID NO: 309 - protein, 5 aa, Dengue virus
EGDGS

SEQ ID NO: 310 - protein, 5 aa, Dengue virus
GADTQ

SEQ ID NO: 311 - protein, 5 aa, Dengue virus
GDGSP

SEQ ID NO: 312 - protein, 5 aa, Dengue virus
GKHGK

SEQ ID NO: 313 - protein, 5 aa, Dengue virus
GNDTG

SEQ ID NO: 314 - protein, 5 aa, Dengue virus
ITPQS

SEQ ID NO: 315 - protein, 5 aa, Dengue virus
NDTGK

SEQ ID NO: 316 - protein, 5 aa, Dengue virus
PHAKK

SEQ ID NO: 317 - protein, 5 aa, Dengue virus
PQSST

SEQ ID NO: 318 - protein, 5 aa, Dengue virus
QSSTT

SEQ ID NO: 319 - protein, 5 aa, Dengue virus
SSTTE

SEQ ID NO: 320 - protein, 5 aa, Dengue virus
TGKHG

SEQ ID NO: 321 - protein, 5 aa, Dengue virus
TPQSS

SEQ ID NO: 322 - protein, 5 aa, Dengue virus
TQGSN

SEQ ID NO: 323 - protein, 5 aa, Dengue virus
TTEAE

SEQ ID NO: 324 - protein, 5 aa, Dengue virus
ATTET

SEQ ID NO: 325 - protein, 5 aa, Dengue virus
DGQGK

SEQ ID NO: 326 - protein, 5 aa, Dengue virus
EDGQG

SEQ ID NO: 327 - protein, 5 aa, Dengue virus
EIQNS

SEQ ID NO: 328 - protein, 5 aa, Dengue virus
ETPTW

SEQ ID NO: 329 - protein, 5 aa, Dengue virus
EVSET

SEQ ID NO: 330 - protein, 5 aa, Dengue virus
GATTE

SEQ ID NO: 331 - protein, 5 aa, Dengue virus
GKAHN

SEQ ID NO: 332 - protein, 5 aa, Dengue virus
GNETQ

SEQ ID NO: 333 - protein, 5 aa, Dengue virus
GQGKA

SEQ ID NO: 334 - protein, 5 aa, Dengue virus
IQNSG

SEQ ID NO: 335 - protein, 5 aa, Dengue virus
KGEDA

SEQ ID NO: 336 - protein, 5 aa, Dengue virus
NETQG

SEQ ID NO: 337 - protein, 5 aa, Dengue virus
NSGGT

SEQ ID NO: 338 - protein, 5 aa, Dengue virus
PQAST

SEQ ID NO: 339 - protein, 5 aa, Dengue virus
QASTT

SEQ ID NO: 340 - protein, 5 aa, Dengue virus
QGKAH

SEQ ID NO: 341 - protein, 5 aa, Dengue virus
QNSGG

SEQ ID NO: 342 - protein, 5 aa, Dengue virus
SETQH

SEQ ID NO: 343 - protein, 5 aa, Dengue virus
SGATT

SEQ ID NO: 344 - protein, 5 aa, Dengue virus
STEDG

SEQ ID NO: 345 - protein, 5 aa, Dengue virus
TEDGQ

SEQ ID NO: 346 - protein, 5 aa, Dengue virus
TETPT

SEQ ID NO: 347 - protein, 5 aa, Dengue virus
TPQAS

SEQ ID NO: 348 - protein, 5 aa, Dengue virus
YKGED

SEQ ID NO: 349 - protein, 5 aa, Dengue virus
ATEVD

SEQ ID NO: 350 - protein, 5 aa, Dengue virus
DSGDG

SEQ ID NO: 351 - protein, 5 aa, Dengue virus
DTSNH

SEQ ID NO: 352 - protein, 5 aa, Dengue virus
EGAGA

SEQ ID NO: 353 - protein, 5 aa, Dengue virus
EVDSG

SEQ ID NO: 354 - protein, 5 aa, Dengue virus
GNDTS

SEQ ID NO: 355 - protein, 5 aa, Dengue virus
ITPRS

SEQ ID NO: 356 - protein, 5 aa, Dengue virus
NDTSN

SEQ ID NO: 357 - protein, 5 aa, Dengue virus
NSRNT

SEQ ID NO: 358 - protein, 5 aa, Dengue virus
PRSPS

SEQ ID NO: 359 - protein, 5 aa, Dengue virus
SRNTS

SEQ ID NO: 360 - protein, 5 aa, Dengue virus
TEVDS

SEQ ID NO: 361 - protein, 5 aa, Dengue virus
TNSRN

SEQ ID NO: 362 - protein, 5 aa, Dengue virus
TPRSP

SEQ ID NO: 363 - protein, 5 aa, Dengue virus
TSNHG

SEQ ID NO: 364 - protein, 5 aa, Dengue virus
VDSGD

SEQ ID NO: 365 - protein, 5 aa, Zika virus
ADTGT

SEQ ID NO: 366 - protein, 5 aa, Zika virus
AGTDG

SEQ ID NO: 367 - protein, 5 aa, Zika virus
DTGHE

SEQ ID NO: 368 - protein, 5 aa, Zika virus
DTGTP

SEQ ID NO: 369 - protein, 5 aa, Zika virus
ESTEN

SEQ ID NO: 370 - protein, 5 aa, Zika virus
ETDEN

SEQ ID NO: 371 - protein, 5 aa, Zika virus
GADTG

SEQ ID NO: 372 - protein, 5 aa, Zika virus
GHETD

SEQ ID NO: 373 - protein, 5 aa, Zika virus
GTDGP

SEQ ID NO: 374 - protein, 5 aa, Zika virus
GTPHW

SEQ ID NO: 375 - protein, 5 aa, Zika virus
HETDE

SEQ ID NO: 376 - protein, 5 aa, Zika virus
ITPNS

SEQ ID NO: 377 - protein, 5 aa, Zika virus
KGRLS

SEQ ID NO: 378 - protein, 5 aa, Zika virus
NSPRA

SEQ ID NO: 379 - protein, 5 aa, Zika virus
PNSPR

SEQ ID NO: 380 - protein, 5 aa, Zika virus
PRAEA

SEQ ID NO: 381 - protein, 5 aa, Zika virus
SPRAE

SEQ ID NO: 382 - protein, 5 aa, Zika virus
TDENR

SEQ ID NO: 383 - protein, 5 aa, Zika virus
TESTE

SEQ ID NO: 384 - protein, 5 aa, Zika virus
TGHET

SEQ ID NO: 385 - protein, 5 aa, Zika virus
TGTPH

SEQ ID NO: 386 - protein, 5 aa, Zika virus
TPNSP

SEQ ID NO: 387 - protein, 5 aa, Dengue virus
EPPFG

SEQ ID NO: 388 - protein, 5 aa, Dengue virus
ETQHG

SEQ ID NO: 389 - protein, 5 aa, Dengue virus
KGSSI

SEQ ID NO: 390 - protein, 5 aa, Dengue virus
QEGAM

SEQ ID NO: 391 - protein, 5 aa, Artificial sequence
  synthetic
GSSIG

SEQ ID NO: 392 - DNA, 1332 bp, Artificial sequence
  synthetic
atggagaccgacaccctgctgctgtgggtgctgctgctgtgggtgcccggctccaccggcgacacgcgtcaccaccaccaccaccacgactacaaggacgacgacgacaagcgctgcatcggcgtgtccaaccgcgacttcgtggagggcatgtccggcggcacctgggtggacatcgtgctggagcacggcggctgcgtgaccgtgatggcccaggacaagcccaccgtggacatcgagctggtgaccaccaccgtgtccaacatggccgaggtgcgctcctactgctacgaggcctccatctccgacatggcctccgactcccgctgccccacccagggcgaggcctacctggacaagcagtccgacacccagtacgtgtgcaagcgcaccctggtgaacggctggggccgcgacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatgatcgtgcaggacaccggccacgagaccgacgagaaccgcgccaaggtggagatcacccccaactcccccgaggcccgcgccaccctgggcggcttcggctccctgggcctggactgcgagccccgcaccggcctggacttctccgacctgtactacctgaccatgaacaacaagcactggctggtgcacaaggagtggttccacgacatccccctgccctggcacgccggcgagaaggcccccaccccccactggaacaacaaggaggccctggtggagttcaaggacgcccacgccaagcgccagaccgtggtggtgctgggctcccaggagggcgccgtgcacaccgccctggccggcgccctggaggccgagatggacggcgccctgcgcaagggctcctccggccacctgaagtgccgcctgaagatggacaagctgcgcctgaagggcgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaacacctccgaggagtccaagatgatgctggagctggacccccccttcggcgactcctacatcgtgatcggcgtgggcgagaagaagatcacccaccactggcaccgctccggctccaccatctag

SEQ ID NO: 393 - protein, 443 aa, Artificial sequence
  synthetic
METDTLLLWVLLLWVPGSTGDTRHHHHHHDYKDDDDKRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVNGWGRDGCGLFGKGSLVTCAKFACSKKMTGKSIQPENLEYRIMLSVHGSQHSGMIVQDTGHETDENRAKVEITPNSPEARATLGGFGSLGLDCEPRTGLDFSDLYYLTMNNKHWLVHKEWFHDIPLPWHAGEKAPTPHWNNKEALVEFKDAHAKRQTVVVLGSQEGAVHTALAGALEAEMDGALRKGSSGHLKCRLKMDKLRLKGVSYSLCTAAFTFTKIPAETLHGTVTVEVQYAGTDGPCKVPAQMAVDMQTLTPVGRLITANPVITNTSEESKMMLELDPPFGDSYIVIGVGEKKITHHWHRSGSTI

SEQ ID NO: 394 - DNA, 2016 bp, Artificial sequence
  synthetic
atggagacagacacactcctgctatgggtactgctgctctgggttccaggttccactggtgacacgcgtcgctgcatcggcgtgtccaaccgcgacttcgtggagggcatgtccggcggcacctgggtggacatcgtgctggagcacggcggctgcgtgaccgtgatggcccaggacaagcccaccgtggacatcgagctggtgaccaccaccgtgtccaacatggccgaggtgcgctcctactgctacgaggcctccatctccgacatggcctccgactcccgctgccccacccagggcgaggcctacctggacaagcagtccgacacccagtacgtgtgcaagcgcaccctggtgaacggctggggccgcgacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatgatcgtgcaggacaccggccacgagaccgacgagaaccgcgccaaggtggagatcacccccaactcccccgaggcccgcgccaccctgggcggcttcggctccctgggcctggactgcgagccccgcaccggcctggacttctccgacctgtactacctgaccatgaacaacaagcactggctggtgcacaaggagtggttccacgacatccccctgccctggcacgccggcgagaaggcccccaccccccactggaacaacaaggaggccctggtggagttcaaggacgcccacgccaagcgccagaccgtggtggtgctgggctcccaggagggcgccgtgcacaccgccctggccggcgccctggaggccgagatggacggcgccctgcgcaagggctcctccggccacctgaagtgccgcctgaagatggacaagctgcgcctgaagggcgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaacacctccgaggagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 395 - protein, 671 aa, Artificial sequence
  synthetic
METDTLLLWVLLLWVPGSTGDTRRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVNGWGRDGCGLFGKGSLVTCAKFACSKKMTGKSIQPENLEYRIMLSVHGSQHSGMIVQDTGHETDENRAKVEITPNSPEARATLGGFGSLGLDCEPRTGLDFSDLYYLTMNNKHWLVHKEWFHDIPLPWHAGEKAPTPHWNNKEALVEFKDAHAKRQTVVVLGSQEGAVHTALAGALEAEMDGALRKGSSGHLKCRLKMDKLRLKGVSYSLCTAAFTFTKIPAETLHGTVTVEVQYAGTDGPCKVPAQMAVDMQTLTPVGRLITANPVITNTSEESKMMLELDPPFGDSYIVIGVGEKKITHHWHRSGSTIDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 396 - DNA, 2037 bp, Artificial sequence
  synthetic
atggagacagacacactcctgctatgggtactgctgctctgggttccaggttccactggtgacacgcgtcatcaccatcaccatcaccgctgcatcggcgtgtccaaccgcgacttcgtggagggcatgtccggcggcacctgggtggacatcgtgctggagcacggcggctgcgtgaccgtgatggcccaggacaagcccaccgtggacatcgagctggtgaccaccaccgtgtccaacatggccgaggtgcgctcctactgctacgaggcctccatctccgacatggcctccgactcccgctgccccacccagggcgaggcctacctggacaagcagtccgacacccagtacgtgtgcaagcgcaccctggtgaacggctggggccgcgacggctgcggcctgttcggcaagggctccctggtgacctgcgccaagttcgcctgctccaagaagatgaccggcaagtccatccagcccgagaacctggagtaccgcatcatgctgtccgtgcacggctcccagcactccggcatgatcgtgcaggacaccggccacgagaccgacgagaaccgcgccaaggtggagatcacccccaactcccccgaggcccgcgccaccctgggcggcttcggctccctgggcctggactgcgagccccgcaccggcctggacttctccgacctgtactacctgaccatgaacaacaagcactggctggtgcacaaggagtggttccacgacatccccctgccctggcacgccggcgagaaggcccccaccccccactggaacaacaaggaggccctggtggagttcaaggacgcccacgccaagcgccagaccgtggtggtgctgggctcccaggagggcgccgtgcacaccgccctggccggcgccctggaggccgagatggacggcgccctgcgcaagggctcctccggccacctgaagtgccgcctgaagatggacaagctgcgcctgaagggcgtgtcctactccctgtgcaccgccgccttcaccttcaccaagatccccgccgagaccctgcacggcaccgtgaccgtggaggtgcagtacgccggcaccgacggcccctgcaaggtgcccgcccagatggccgtggacatgcagaccctgacccccgtgggccgcctgatcaccgccaaccccgtgatcaccaacacctccgaggagtccaagatgatgctggagctggacccccccttcggcgactcctacatcgtgatcggcgtgggcgagaagaagatcacccaccactggcaccgctccggctccaccatcgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 397 - protein, 678 aa, Artificial sequence
  synthetic
METDTLLLWVLLLWVPGSTGDTRHHHHHHRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVNGWGRDGCGLFGKGSLVTCAKFACSKKMTGKSIQPENLEYRIMLSVHGSQHSGMIVQDTGHETDENRAKVEITPNSPEARATLGGFGSLGLDCEPRTGLDFSDLYYLTMNNKHWLVHKEWFHDIPLPWHAGEKAPTPHWNNKEALVEFKDAHAKRQTVVVLGSQEGAVHTALAGALEAEMDGALRKGSSGHLKCRLKMDKLRLKGVSYSLCTAAFTFTKIPAETLHGTVTVEVQYAGTDGPCKVPAQMAVDMQTLTPVGRLITANPVITNTSEESKMMLELDPPFGDSYIVIGVGEKKITHHWHRSGSTIDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 398 - DNA, 1539 bp, Artificial sequence
  synthetic
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagaagggccgcctgtcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccagaccgacaaggagaagggcatctcctccgacaacgagtccgtggcctcctgcaactccgtgaaggtgaaccccgccgcccagcccgtgtcctcccccgcccagacctccgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 399 - protein, 512 aa, Artificial sequence
  synthetic
METDTLLLWVLLLWVPGSTGDTRHHHHHHVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 400 - DNA, 1539 bp, Artificial sequence
  synthetic
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagctgcgcaagggctcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccagaccgacaaggagaagggcatctcctccgacaacgagtccgtggcctcctgcaactccgtgaaggtgaaccccgccgcccagcccgtgtcctcccccgcccagacctccgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 401 - protein, 512 aa, Artificial sequence
  synthetic
METDTLLLWVLLLWVPGSTGDTRHHHHHHVGITMPRTKPSAPAGALKTPGTGKTDDAKVSELRKGSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 402 - DNA, 1539 bp, Artificial sequence
  synthetic
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagaagggccgcctgtcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctccgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 403 - protein, 512 aa, Artificial sequence
  synthetic
METDTLLLWVLLLWVPGSTGDTRHHHHHHVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTSDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 404 - DNA, 1539 bp, Artificial sequence
  synthetic
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagtccaccaacgacgaccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctccgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 405 - protein, 512 aa, Artificial sequence
  synthetic
METDTLLLWVLLLWVPGSTGDTRHHHHHHVGITMPRTKPSAPAGALKTPGTGKTDDAKVSESTNDDPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTSDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 406 - DNA, 1569 bp, Artificial sequence
  synthetic
atggagacagacacactcctgctatgggtactgctgctctgggttccaggttccactggtgacacgcgtcatcaccatcaccatcacgtgggcatcaccatgccccgcaccaagccctccgcccccgccggcgccctgaagacccccggcaccggcaagaccgacgacgccaaggtgtccgagtccaaggacgtgcagctgaagaacatcaccgactacatgtacctgcccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctccgactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 407 - protein, 522 aa, Artificial sequence
  synthetic
METDTLLLWVLLLWVPGSTGDTRHHHHHHVGITMPRTKPSAPAGALKTPGTGKTDDAKVSESKDVQLKNITDYMYLPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTSDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 408 - DNA, 1542 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaaggtgggcatcaccatgccccgcaccaagccctccgcccccgccggcgccctgaagacccccggcaccggcaagaccgacgacgccaaggtgtccgagaagggccgcctgtcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccagaccgacaaggagaagggcatctcctccgacaacgagtccgtggcctcctgcaactccgtgaaggtgaaccccgccgcccagcccgtgtcctcccccgcccagacctcccatcaccatcaccatcactag

SEQ ID NO: 409 - protein, 513 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSHHHHHH

SEQ ID NO: 410 - DNA, 1542 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaaggtgggcatcaccatgccccgcaccaagccctccgcccccgccggcgccctgaagacccccggcaccggcaagaccgacgacgccaaggtgtccgagctgcgcaagggctcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccagaccgacaaggagaagggcatctcctccgacaacgagtccgtggcctcctgcaactccgtgaaggtgaaccccgccgcccagcccgtgtcctcccccgcccagacctcccatcaccatcaccatcactag

SEQ ID NO: 411 - protein, 513 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKVGITMPRTKPSAPAGALKTPGTGKTDDAKVSELRKGSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSHHHHHH

SEQ ID NO: 412 - DNA, 1542 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaaggtgggcatcaccatgccccgcaccaagccctccgcccccgccggcgccctgaagacccccggcaccggcaagaccgacgacgccaaggtgtccgagaagggccgcctgtcccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctcccatcaccatcaccatcactag

SEQ ID NO: 413 - protein, 513 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTSHHHHHH

SEQ ID NO: 414 - DNA, 1542 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaaggtgggcatcaccatgccccgcaccaagccctccgcccccgccggcgccctgaagacccccggcaccggcaagaccgacgacgccaaggtgtccgagtccaccaacgacgaccccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctcccatcaccatcaccatcactag

SEQ ID NO: 415 - protein, 513 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKVGITMPRTKPSAPAGALKTPGTGKTDDAKVSESTNDDPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTSHHHHHH

SEQ ID NO: 416 - DNA, 1572 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaaggtgggcatcaccatgccccgcaccaagccctccgcccccgccggcgccctgaagacccccggcaccggcaagaccgacgacgccaaggtgtccgagtccaaggacgtgcagctgaagaacatcaccgactacatgtacctgcccaaggcctcccaggtgaagcgctccccctccgacgccggccgctcctccggcgacgagtccaagaagcccctgccctcctcctcccgcacccccaccgccaacgccaactccttcggcttcaagaagcagtccggctccgccgccggcctggccatgatcaccgcctccggcgtgaccgtgacctcccgctccgccaccctgggcaagatccccaagtcctccgccctggtgtcccgctccgccggccgcaagtcctccatggacggcgcccagaaccaggacgacggctacctggccctgtcctcccgcaccaacctgcagtaccgctccctgccccgcccctccaagtccaactcccgcaacggcgccggcaaccgctcctccacctcctccatcgactccaacatctcctccaagtccgccggcctgcccgtgcccaagctgcgcgagccctccaagaccgccctgggctcctccctgcccggcctggtgaaccaggacacccgcgagaagggcatctcctccgacaacgagtccgtggcctcctgcaactccgtgaaggtgaaccccgccgcccagcccgtgtcctcccccgcccagacctcccatcaccatcaccatcactag

SEQ ID NO: 417 - protein, 523 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKVGITMPRTKPSAPAGALKTPGTGKTDDAKVSESKDVQLKNITDYMYLPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQDTREKGISSDNESVASCNSVKVNPAAQPVSSPAQTSHHHHHH

SEQ ID NO: 418 - DNA, 1032 bp, Artificial sequence
  synthetic
atggagacagacacactcctgctatgggtactgctgctctgggttccaggttccactggtgacacgcgtcatcaccatcaccatcactacccctccaagcccgacaaccccggcgaggacgcccccgccgaggacatggcccgctactactccgccctgcgccactacatcaacctgatcacccgccagcgctacgctgcccgcaagcgctcctcccccgagaccctgatctccgacctgctgatgcgcgagtccaccgagaacgtgccccgcacccgcctggaggaccccgccatgtgggactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 419 - protein, 343 aa, Artificial sequence
  synthetic
METDTLLLWVLLLWVPGSTGDTRHHHHHHYPSKPDNPGEDAPAEDMARYYSALRHYINLITRQRYAARKRSSPETLISDLLMRESTENVPRTRLEDPAMWDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 420 - DNA, 1026 bp, Artificial sequence
  synthetic
atggagacagacacactcctgctatgggtactgctgctctgggttccaggttccactggtgacacgcgtcatcaccatcaccatcactacccctccaagcccgacaacccccccgacgccgagggcgccgaggacatggcccgctactactccgccctgcgccactacatcaacctgatcacccgccagcgctacgctgcccgctcctcccccgagaccctgatctccgacctgctgatgcgcgagtccaccgagaacgtgccccgcacccgcctggaggaccccgccatgtgggactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 421 - protein, 341 aa, Artificial sequence
  synthetic
METDTLLLWVLLLWVPGSTGDTRHHHHHHYPSKPDNPPDAEGAEDMARYYSALRHYINLITRQRYAARSSPETLISDLLMRESTENVPRTRLEDPAMWDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 422 - DNA, 1032 bp, Artificial sequence
  synthetic
atggagacagacacactcctgctatgggtactgctgctctgggttccaggttccactggtgacacgcgtcatcaccatcaccatcactacccctccaagcccgacaaccccggcgaggacgcccccgccgaggacatggcccgctactactccgccctgcgccactacatcaacctgatcacccgccagcgctacgctgcccgcaagcgctcctcccccgagaccctgatctccgacctgctgatgcgcaacacctccgaggaggtgccccgcacccgcctggaggaccccgccatgtgggactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 423 - protein, 343 aa, Artificial sequence
  synthetic
METDTLLLWVLLLWVPGSTGDTRHHHHHHYPSKPDNPGEDAPAEDMARYYSALRHYINLITRQRYAARKRSSPETLISDLLMRNTSEEVPRTRLEDPAMWDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 424 - DNA, 1032 bp, Artificial sequence
  synthetic
atggagacagacacactcctgctatgggtactgctgctctgggttccaggttccactggtgacacgcgtcatcaccatcaccatcactacccctccaagcccgacaacccccccgacgccgagggcgccgaggacatggcccgctactactccgccctgcgccactacatcaacctgatcacccgccagcgctacgctgcccgcaagcgctcctcccccgagaccctgatctccgacctgctgatgcgctccaccaacgacgacgtgccccgcacccgcctggaggaccccgccatgtgggactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 425 - protein, 343 aa, Artificial sequence
  synthetic
METDTLLLWVLLLWVPGSTGDTRHHHHHHYPSKPDNPPDAEGAEDMARYYSALRHYINLITRQRYAARKRSSPETLISDLLMRSTNDDVPRTRLEDPAMWDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 426 - DNA, 1062 bp, Artificial sequence
  synthetic
atggagacagacacactcctgctatgggtactgctgctctgggttccaggttccactggtgacacgcgtcatcaccatcaccatcactacccctccaagcccgacaacccccccgacgccgagggcgccgaggacatggcccgctactactccgccctgcgccactacatcaacctgatcacccgccagcgctacgctgcccgcaagcgctcctcccccgagaccctgatctccgacctgctgatgcgctccaaggacgtgcagctgaagaacatcaccgactacatgtacctggtgccccgcacccgcctggaggaccccgccatgtgggactacaaggacgacgacgacaaggtcgacgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatag

SEQ ID NO: 427 - protein, 353 aa, Artificial sequence
  synthetic
METDTLLLWVLLLWVPGSTGDTRHHHHHHYPSKPDNPPDAEGAEDMARYYSALRHYINLITRQRYAARKRSSPETLISDLLMRSKDVQLKNITDYMYLVPRTRLEDPAMWDYKDDDDKVDEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 428 - DNA, 1035 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaagtacccctccaagcccgacaaccccggcgaggacgcccccgccgaggacatggcccgctactactccgccctgcgccactacatcaacctgatcacccgccagcgctacgctgcccgcaagcgctcctcccccgagaccctgatctccgacctgctgatgcgcgagtccaccgagaacgtgccccgcacccgcctggaggaccccgccatgtggcatcaccatcaccatcactag

SEQ ID NO: 429 - protein, 344 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKYPSKPDNPGEDAPAEDMARYYSALRHYINLITRQRYAARKRSSPETLISDLLMRESTENVPRTRLEDPAMWHHHHHH

SEQ ID NO: 430 - DNA, 1029 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaagtacccctccaagcccgacaacccccccgacgccgagggcgccgaggacatggcccgctactactccgccctgcgccactacatcaacctgatcacccgccagcgctacgctgcccgctcctcccccgagaccctgatctccgacctgctgatgcgcgagtccaccgagaacgtgccccgcacccgcctggaggaccccgccatgtggcatcaccatcaccatcactag

SEQ ID NO: 431 - protein, 342 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKYPSKPDNPPDAEGAEDMARYYSALRHYINLITRQRYAARSSPETLISDLLMRESTENVPRTRLEDPAMWHHHHHH

SEQ ID NO: 432 - DNA, 1035 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaagtacccctccaagcccgacaaccccggcgaggacgcccccgccgaggacatggcccgctactactccgccctgcgccactacatcaacctgatcacccgccagcgctacgctgcccgcaagcgctcctcccccgagaccctgatctccgacctgctgatgcgcaacacctccgaggaggtgccccgcacccgcctggaggaccccgccatgtggcatcaccatcaccatcactag

SEQ ID NO: 433 - protein, 344 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKYPSKPDNPGEDAPAEDMARYYSALRHYINLITRQRYAARKRSSPETLISDLLMRNTSEEVPRTRLEDPAMWHHHHHH

SEQ ID NO: 434 - DNA, 1035 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaagtacccctccaagcccgacaacccccccgacgccgagggcgccgaggacatggcccgctactactccgccctgcgccactacatcaacctgatcacccgccagcgctacgctgcccgcaagcgctcctcccccgagaccctgatctccgacctgctgatgcgctccaccaacgacgacgtgccccgcacccgcctggaggaccccgccatgtggcatcaccatcaccatcactag

SEQ ID NO: 435 - protein, 344 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKYPSKPDNPPDAEGAEDMARYYSALRHYINLITRQRYAARKRSSPETLISDLLMRSTNDDVPRTRLEDPAMWHHHHHH

SEQ ID NO: 436 - DNA, 1065 bp, Artificial sequence
  synthetic
atggagacagacacactcctgctatgggtactgctgctctgggttccaggttccactggtgacacgcgtgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaagcggccgcagactacaaggacgacgacgacaagtacccctccaagcccgacaacccccccgacgccgagggcgccgaggacatggcccgctactactccgccctgcgccactacatcaacctgatcacccgccagcgctacgctgcccgcaagcgctcctcccccgagaccctgatctccgacctgctgatgcgctccaaggacgtgcagctgaagaacatcaccgactacatgtacctggtgccccgcacccgcctggaggaccccgccatgtggcatcaccatcaccatcactag

SEQ ID NO: 437 - protein, 354 aa, Artificial sequence
  synthetic
METDTLLLWVLLLWVPGSTGDTREPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGKAAADYKDDDDKYPSKPDNPPDAEGAEDMARYYSALRHYINLITRQRYAARKRSSPETLISDLLMRSKDVQLKNITDYMYLVPRTRLEDPAMWHHHHHH

SEQ ID NO: 438 - DNA, 1881 bp, Zika virus
atggagacagacacactcctgctatgggtactgctgctctgggttccaggttccactggtgacacgcgtgccgacgtgggctgctccgtggacttctccaagaaggagacccgctgcggcaccggcgtgttcgtgtacaacgacgtggaggcctggcgcgaccgctacaagtaccaccccgactccccccgccgcctggccgccgccgtgaagcaggcctgggaggacggcatctgcggcatctcctccgtgtcccgcatggagaacatcatgtggcgctccgtggagggcgagctgaacgccatcctggaggagaacggcgtgcagctgaccgtggtggtgggctccgtgaagaaccccatgtggcgcggcccccagcgcctgcccgtgcccgtgaacgagctgccccacggctggaaggcctggggcaagtcccacttcgtgcgcgccgccaagaccaacaactccttcgtggtggacggcgacaccctgaaggagtgccccctgaagcaccgcgcctggaactccttcctggtggaggaccacggcttcggcgtgttccacacctccgtgtggctgaaggtgcgcgaggactactccctggagtgcgaccccgccgtgatcggcaccgccgtgaagggcaaggaggccgtgcactccgacctgggctactggatcgagtccgagaagaacgacacctggcgcctgaagcgcgcccacctgatcgagatgaagacctgcgagtggcccaagtcccacaccctgtggaccgacggcatcgaggagtccgacctgatcatccccaagtccctggccggccccctgtcccaccacaacacccgcgagggctaccgcacccagatgaagggcccctggcactccgaggagctggagatccgcttcgaggagtgccccggcaccaaggtgcacgtggaggagacctgcggcacccgcggcccctccctgcgctccaccaccgcctccggccgcgtgatcgaggagtggtgctgccgcgagtgcaccatgccccccctgtccttccgcgccaaggacggctgctggtacggcatggagatccgcccccgcaaggagcccgagtccaacctggtgcgctccatggtgaccgccggctccaccgaccacatggaccacgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 439 - protein, 626 aa, Zika virus
METDTLLLWVLLLWVPGSTGDTRADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 440 - DNA, 1881 bp, Zika virus
atggagacagacacactcctgctatgggtactgctgctctgggttccaggttccactggtgacacgcgtgccgacgtgggctgctccgtggacttctccaagaaggagacccgctgcggcaccggcgtgttcgtgtacaacgacgtggaggcctggcgcgaccgctacaagtaccaccccgactccccccgccgcctggccgccgccgtgaagcaggcctgggaggacggcatctgcggcatctcctccgtgtcccgcatggagaacatcatgtggcgctccgtggagggcgagctgaacgccatcctggaggagaacggcgtgcagctgaccgtggtggtgggctccgtgaagaaccccatgtggcgcggcccccagcgcctgcccgtgcccgtgaacgagctgccccacggctggaaggcctggggcaagtcccacttcgtgcgcgccgccaagaccaacaactccttcgtggtggacggcgacaccctgaaggagtgccccctgaagcaccgcgcctggaactccttcctggtggaggaccacggcttcggcgtgttccacacctccgtgtggctgaaggtgcgcgaggactactccctggagtgcgaccccgccgtgatcggcaccgccgtgaagggcaaggaggccgtgcactccgacctgggctactggatcgagtccgagaagaacgacacctggcgcctgaagcgcgcccacctgatcgagatgaagacctgcgagtggcccaagtcccacaccctgtggaccgacggcatcgaggagtccgacctgatcatccccaagtccctggccggccccctgtcccaccacaacacccgcgagggctaccgcacccagatgaagggcccctggcactccgaggagctggagatccgcttcgaggagtgccccggcaccaaggtgcacgtggaggagacctgcggcacccgcggcccctccctgcgcatgaccaccgtgatgggccgcgtgatcgaggagtggtgctgccgcgagtgcaccatgccccccctgtccttccgcgccaaggacggctgctggtacggcatggagatccgcccccgcaaggagcccgagtccaacctggtgcgctccatggtgaccgccggctccaccgaccacatggaccacgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 441 - protein, 626 aa, Zika virus
METDTLLLWVLLLWVPGSTGDTRADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRMTTVMGRVIEEWCCRECTMPPLSFRAKDGCWYGMEIRPRKEPESNLVRSMVTAGSTDHMDHDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 442 - DNA, 1368 bp, Zika virus
atggagacagacacactcctgctatgggtactgctgctctgggttccaggttccactggtgacacgcgtgtgcgcgaggactactccctggagtgcgaccccgccgtgatcggcaccgccgtgaagggcaaggaggccgtgcactccgacctgggctactggatcgagtccgagaagaacgacacctggcgcctgaagcgcgcccacctgatcgagatgaagacctgcgagtggcccaagtcccacaccctgtggaccgacggcatcgaggagtccgacctgatcatccccaagtccctggccggccccctgtcccaccacaacacccgcgagggctaccgcacccagatgaagggcccctggcactccgaggagctggagatccgcttcgaggagtgccccggcaccaaggtgcacgtggaggagacctgcggcacccgcggcccctccctgcgctccaccaccgcctccggccgcgtgatcgaggagtggtgctgccgcgagtgcaccatgccccccctgtccttccgcgccaaggacggctgctggtacggcatggagatccgcccccgcaaggagcccgagtccaacctggtgcgctccatggtgaccgccggctccaccgaccacatggaccacgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 443 - protein, 455 aa, Zika virus
METDTLLLWVLLLWVPGSTGDTRVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSTDHMDHDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 444 - DNA, 1368 bp, Zika virus
atggagacagacacactcctgctatgggtactgctgctctgggttccaggttccactggtgacacgcgtgtgcgcgaggactactccctggagtgcgaccccgccgtgatcggcaccgccgtgaagggcaaggaggccgtgcactccgacctgggctactggatcgagtccgagaagaacgacacctggcgcctgaagcgcgcccacctgatcgagatgaagacctgcgagtggcccaagtcccacaccctgtggaccgacggcatcgaggagtccgacctgatcatccccaagtccctggccggccccctgtcccaccacaacacccgcgagggctaccgcacccagatgaagggcccctggcactccgaggagctggagatccgcttcgaggagtgccccggcaccaaggtgcacgtggaggagacctgcggcacccgcggcccctccctgcgcatgaccaccgtgatgggccgcgtgatcgaggagtggtgctgccgcgagtgcaccatgccccccctgtccttccgcgccaaggacggctgctggtacggcatggagatccgcccccgcaaggagcccgagtccaacctggtgcgctccatggtgaccgccggctccaccgaccacatggaccacgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 445 - protein, 456 aa, Zika virus
METDTLLLWVLLLWVPGSTGDTRVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRMTTVMGRVIEEWCCRECTMPPLSFRAKDGCWYGMEIRPRKEPESNLVRSMVTAGSTDHMDHDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKH

SEQ ID NO: 446 - protein, 15 aa, Dengue virus
ELLKTEVTNPAVLRK

SEQ ID NO: 447 - protein, 15 aa, Dengue virus
IATITPQAPTSEIQL

SEQ ID NO: 448 - protein, 15 aa, Dengue virus
WTSGASTSQETWNRQ

SEQ ID NO: 449 - protein, 15 aa, Dengue virus
TGATEIQTSGTTTIF

SEQ ID NO: 450 - protein, 15 aa, Dengue virus
VQVKYEGTDAPCKIP

SEQ ID NO: 451 - protein, 15 aa, Dengue virus
FLTQDEKGVTQNGRL

SEQ ID NO: 452 - protein, 15 aa, Dengue virus
ANPIVTDKEKPVNIE

SEQ ID NO: 453 - protein, 15 aa, Dengue virus
PVNIETEPPFGESYI

SEQ ID NO: 454 - protein, 15 aa, Dengue virus
WLPGADTQGSNWIQK

SEQ ID NO: 455 - protein, 15 aa, Dengue virus
PGADTQGSNWIQKET

SEQ ID NO: 456 - protein, 15 aa, Dengue virus
VTFKNPHAKKQDVVV

SEQ ID NO: 457 - protein, 15 aa, Dengue virus
IRVQYEGDGSPCKIP

SEQ ID NO: 458 - protein, 15 aa, Dengue virus
VQYEGDGSPCKIPFE

SEQ ID NO: 459 - protein, 15 aa, Dengue virus
PIVTEKDSPVNIEAE

SEQ ID NO: 460 - protein, 15 aa, Dengue virus
PVNIEAEPPFGDSYI

SEQ ID NO: 461 - protein, 15 aa, Dengue virus
NIEAEPPFGDSYIIV

SEQ ID NO: 462 - protein, 15 aa, Dengue virus
QHQVGNETQGVTAEI

SEQ ID NO: 463 - protein, 15 aa, Dengue virus
WTSGATTETPTWNRK

SEQ ID NO: 464 - protein, 15 aa, Dengue virus
TGATEIQNSGGTSIF

SEQ ID NO: 465 - protein, 15 aa, Dengue virus
VLKKEVSETQHGTIL

SEQ ID NO: 466 - protein, 15 aa, Dengue virus
KVEYKGEDAPCKIPF

SEQ ID NO: 467 - protein, 15 aa, Dengue virus
KVEYKGEDVPCKIPF

SEQ ID NO: 468 - protein, 15 aa, Dengue virus
PCKIPFSTEDGQGKA

SEQ ID NO: 469 - protein, 15 aa, Dengue virus
PVVTKKEEPVNIEAE

SEQ ID NO: 470 - protein, 15 aa, Dengue virus
VNIEAEPPFGESNIV

SEQ ID NO: 471 - protein, 15 aa, Dengue virus
DFELTKTTAKEVALL

SEQ ID NO: 472 - protein, 15 aa, Dengue virus
HAVGNDTSNHGVTAT

SEQ ID NO: 473 - protein, 15 aa, Dengue virus
VTATITPRSPSVEVE

SEQ ID NO: 474 - protein, 15 aa, Dengue virus
GATEVDSGDGNHMFA

SEQ ID NO: 475 - protein, 15 aa, Dengue virus
DKEMAETQHGTTVVK

SEQ ID NO: 476 - protein, 15 aa, Dengue virus
VKVKYEGAGAPCKVP

SEQ ID NO: 477 - protein, 15 aa, Dengue virus
ISSIPLAENTNSVTN

SEQ ID NO: 478 - protein, 15 aa, Dengue virus
PLAENTNSVTNIELE

SEQ ID NO: 479 - protein, 15 aa, Yellow fever virus
ETVAIDRPAEVRKVC

SEQ ID NO: 480 - protein, 15 aa, Yellow fever virus
HVGAKQENWNTDIKT

SEQ ID NO: 481 - protein, 15 aa, Yellow fever virus
LKFDALSGSQEVEFI

SEQ ID NO: 482 - protein, 15 aa, Yellow fever virus
DLTLPWQSGSGGVWR

SEQ ID NO: 483 - protein, 15 aa, Yellow fever virus
VLALGNQEGSLKTAL

SEQ ID NO: 484 - protein, 15 aa, Yellow fever virus
AMRVTKDTNDNNLYK

SEQ ID NO: 485 - protein, 15 aa, Yellow fever virus
FFVKNPTDTGHGTVV

SEQ ID NO: 486 - protein, 15 aa, Yellow fever virus
VNPIASTNDDEVLIE

SEQ ID NO: 487 - protein, 15 aa, Yellow fever virus
VTVNPIASTNDDEVL

SEQ ID NO: 488 - protein, 15 aa, Yellow fever virus
VLIEVNPPFGDSYII

SEQ ID NO: 489 - protein, 15 aa, West Nile virus
TIMSKDKPTIDVKMM

SEQ ID NO: 490 - protein, 15 aa, West Nile virus
FVHGPTTVESHGKIG

SEQ ID NO: 491 - protein, 15 aa, West Nile virus
VTVDCEPRSGIDTSA

SEQ ID NO: 492 - protein, 15 aa, West Nile virus
SVVALGSQEGALHQA

SEQ ID NO: 493 - protein, 15 aa, West Nile virus
EKLQLKGTTYGVCSK

SEQ ID NO: 494 - protein, 15 aa, West Nile virus
KFARTPADTGHGTVV

SEQ ID NO: 495 - protein, 15 aa, West Nile virus
LELQYTGTDGPCKVP

SEQ ID NO: 496 - protein, 15 aa, West Nile virus
YIVVGRGEQQINHHW

SEQ ID NO: 497 - protein, 15 aa, Zika virus
DFVEGMSGGTWVDIV

SEQ ID NO: 498 - protein, 15 aa, Zika virus
TVMAQDKPTVDIELV

SEQ ID NO: 499 - protein, 15 aa, Zika virus
AYLDKQSDTQYVCKR

SEQ ID NO: 500 - protein, 15 aa, Zika virus
SKKMTGKSIQPENLE

SEQ ID NO: 501 - protein, 15 aa, Zika virus
IMLSVHGSQHSGMIV

SEQ ID NO: 502 - protein, 15 aa, Zika virus
VNDTGHETDENRAKV

SEQ ID NO: 503 - protein, 15 aa, Zika virus
KVEITPNSPRAEATL

SEQ ID NO: 504 - protein, 15 aa, Zika virus
ITPNSPRAEATLGGF

SEQ ID NO: 505 - protein, 15 aa, Zika virus
AGADTGTPHWNNKEA

SEQ ID NO: 506 - protein, 15 aa, Zika virus
EMDGAKGRLSSGHLK

SEQ ID NO: 507 - protein, 15 aa, Zika virus
EVQYAGTDGPCKVPA

SEQ ID NO: 508 - protein, 15 aa, Zika virus
ITANPVITESTENSK

SEQ ID NO: 509 - protein, 15 aa, Zika virus
NPVITESTENSKMML

SEQ ID NO: 510 - protein, 15 aa, Zika virus
VITESTENSKMMLEL

SEQ ID NO: 511 - protein, 15 aa, chikungunya virus
ALERIRNEATDGTLK

SEQ ID NO: 512 - protein, 15 aa, chikungunya virus
GREKFHSRPQHGKEL

SEQ ID NO: 513 - protein, 15 aa, chikungunya virus
VPRNAELGDRKGKIH

SEQ ID NO: 514 - protein, 15 aa, chikungunya virus
RVPKARNPTVTYGKN

SEQ ID NO: 515 - protein, 15 aa, chikungunya virus
PKARNPTVTYGKNQV

SEQ ID NO: 516 - protein, 15 aa, chikungunya virus
SYRNMGEEPNYQEEW

SEQ ID NO: 517 - protein, 15 aa, chikungunya virus
EVTWGNNEPYKYWPQ

SEQ ID NO: 518 - protein, 15 aa, chikungunya virus
PQLSTNGTAHGHPHE

SEQ ID NO: 519 - protein, 5 aa, Dengue virus
EVTNP

SEQ ID NO: 520 - protein, 5 aa, Dengue virus
PQAPT

SEQ ID NO: 521 - protein, 5 aa, Dengue virus
STSQE

SEQ ID NO: 522 - protein, 5 aa, Dengue virus
IQTSG

SEQ ID NO: 523 - protein, 5 aa, Dengue virus
EGTDA

SEQ ID NO: 524 - protein, 5 aa, Dengue virus
EKGVT

SEQ ID NO: 525 - protein, 5 aa, Dengue virus
TDKEK

SEQ ID NO: 526 - protein, 5 aa, Dengue virus
TEPPF

SEQ ID NO: 527 - protein, 5 aa, Dengue virus
DTQGS

SEQ ID NO: 528 - protein, 5 aa, Dengue virus
QGSNW

SEQ ID NO: 529 - protein, 5 aa, Dengue virus
PHAKK

SEQ ID NO: 530 - protein, 5 aa, Dengue virus
EGDGS

SEQ ID NO: 531 - protein, 5 aa, Dengue virus
DGSPC

SEQ ID NO: 532 - protein, 5 aa, Dengue virus
KDSPV

SEQ ID NO: 533 - protein, 5 aa, Dengue virus
AEPPF

SEQ ID NO: 534 - protein, 5 aa, Dengue virus
PPFGD

SEQ ID NO: 535 - protein, 5 aa, Dengue virus
NETQG

SEQ ID NO: 536 - protein, 5 aa, Dengue virus
TTETP

SEQ ID NO: 537 - protein, 5 aa, Dengue virus
IQNSG

SEQ ID NO: 538 - protein, 5 aa, Dengue virus
VSETQ

SEQ ID NO: 539 - protein, 5 aa, Dengue virus
GEDAP

SEQ ID NO: 540 - protein, 5 aa, Dengue virus
GEDVP

SEQ ID NO: 541 - protein, 5 aa, Dengue virus
FSTED

SEQ ID NO: 542 - protein, 5 aa, Dengue virus
KEEPV

SEQ ID NO: 543 - protein, 5 aa, Dengue virus
EPPFG

SEQ ID NO: 544 - protein, 5 aa, Dengue virus
KTTAK

SEQ ID NO: 545 - protein, 5 aa, Dengue virus
DTSNH

SEQ ID NO: 546 - protein, 5 aa, Dengue virus
TPRSP

SEQ ID NO: 547 - protein, 5 aa, Dengue virus
DSGDG

SEQ ID NO: 548 - protein, 5 aa, Dengue virus
ETQHG

SEQ ID NO: 549 - protein, 5 aa, Dengue virus
EGAGA

SEQ ID NO: 550 - protein, 5 aa, Dengue virus
LAENT

SEQ ID NO: 551 - protein, 5 aa, Dengue virus
TNSVT

SEQ ID NO: 552 - protein, 5 aa, Dengue virus
ETQHG

SEQ ID NO: 553 - protein, 5 aa, Dengue virus
EPPFG

SEQ ID NO: 554 - protein, 5 aa, Dengue virus
DRGWG

SEQ ID NO: 555 - protein, 5 aa, Dengue virus
SPRTG

SEQ ID NO: 556 - protein, 5 aa, Dengue virus
TARGA

SEQ ID NO: 557 - protein, 5 aa, Dengue virus
GSSIG

SEQ ID NO: 558 - protein, 5 aa, Dengue virus
RCPTQ

SEQ ID NO: 559 - protein, 5 aa, Dengue virus
PPFGD

SEQ ID NO: 560 - protein, 5 aa, Yellow fever virus
DRPAE

SEQ ID NO: 561 - protein, 5 aa, Yellow fever virus
QENWN

SEQ ID NO: 562 - protein, 5 aa, Yellow fever virus
LSGSQ

SEQ ID NO: 563 - protein, 5 aa, Yellow fever virus
WQSGS

SEQ ID NO: 564 - protein, 5 aa, Yellow fever virus
NQEGS

SEQ ID NO: 565 - protein, 5 aa, Yellow fever virus
KDTND

SEQ ID NO: 566 - protein, 5 aa, Yellow fever virus
PTDTG

SEQ ID NO: 567 - protein, 5 aa, Yellow fever virus
STNDD

SEQ ID NO: 568 - protein, 5 aa, Yellow fever virus
IASTN

SEQ ID NO: 569 - protein, 5 aa, Yellow fever virus
NPPFG

SEQ ID NO: 570 - protein, 5 aa, Zika virus
QSDTQ

SEQ ID NO: 571 - protein, 5 aa, Zika virus
GKSIQ

SEQ ID NO: 572 - protein, 5 aa, Zika virus
HGSQH

SEQ ID NO: 573 - protein, 5 aa, Zika virus
HETDE

SEQ ID NO: 574 - protein, 5 aa, Zika virus
PNSPR

SEQ ID NO: 575 - protein, 5 aa, Zika virus
PRAEA

SEQ ID NO: 576 - protein, 5 aa, Zika virus
GTPHW

SEQ ID NO: 577 - protein, 5 aa, Zika virus
KGRLS

SEQ ID NO: 578 - protein, 5 aa, Zika virus
GTDGP

SEQ ID NO: 579 - protein, 5 aa, Zika virus
VITES

SEQ ID NO: 580 - protein, 5 aa, Zika virus
ESTEN

SEQ ID NO: 581 - protein, 5 aa, Zika virus
TENSK

SEQ ID NO: 582 - protein, 5 aa, chikungunya virus
RNEAT

SEQ ID NO: 583 - protein, 5 aa, chikungunya virus
HSRPQ

SEQ ID NO: 584 - protein, 5 aa, chikungunya virus
EFGDR

SEQ ID NO: 585 - protein, 5 aa, chikungunya virus
RNPTV

SEQ ID NO: 586 - protein, 5 aa, chikungunya virus
PTVTY

SEQ ID NO: 587 - protein, 5 aa, chikungunya virus
GEEPN

SEQ ID NO: 588 - protein, 5 aa, chikungunya virus
NNEPY

SEQ ID NO: 589 - protein, 5 aa, chikungunya virus
NGTAH

SEQ ID NO: 590 - protein, 15 aa, Dengue virus
YKFQADSPKRLSAAI

SEQ ID NO: 591 - protein, 15 aa, Dengue virus
AQGKKMIRPQPMEHK

SEQ ID NO: 592 - protein, 15 aa, Dengue virus
IDGPDTPECPDGQRA

SEQ ID NO: 593 - protein, 15 aa, Dengue virus
PDTPECPDGQRAWNI

SEQ ID NO: 594 - protein, 15 aa, Dengue virus
MSAAIKDSKAVHADM

SEQ ID NO: 595 - protein, 15 aa, Dengue virus
YWIESEKNETWKLAR

SEQ ID NO: 596 - protein, 15 aa, Dengue virus
DEHCGNRGPSLRTTT

SEQ ID NO: 597 - protein, 15 aa, Dengue virus
GPSLRTTTVTGKIIH

SEQ ID NO: 598 - protein, 15 aa, Dengue virus
KFQPESPSKLASAIQ

SEQ ID NO: 599 - protein, 15 aa, Dengue virus
AGKRSLRPQPTELKY

SEQ ID NO: 600 - protein, 15 aa, Dengue virus
KAKMLSTESHNQTFL

SEQ ID NO: 601 - protein, 15 aa, Dengue virus
DGPETAECPNTNRAW

SEQ ID NO: 602 - protein, 15 aa, Dengue virus
SAAIKDNRAVHADMG

SEQ ID NO: 603 - protein, 15 aa, Dengue virus
IIPKNFAGPVSQHNY

SEQ ID NO: 604 - protein, 15 aa, Dengue virus
YRPGYHTQTAGPWHL

SEQ ID NO: 605 - protein, 15 aa, Dengue virus
VVVTEDCGNRGPSLR

SEQ ID NO: 606 - protein, 15 aa, Dengue virus
QYKFQADSPKRLATA

SEQ ID NO: 607 - protein, 15 aa, Dengue virus
LKQGKRTLTPQPMEL

SEQ ID NO: 608 - protein, 15 aa, Dengue virus
IIDGPNTPECPSASR

SEQ ID NO: 609 - protein, 15 aa, Dengue virus
MSAAVKDERAVHADM

SEQ ID NO: 610 - protein, 15 aa, Dengue virus
WIESQKNGSWKLEKA

SEQ ID NO: 611 - protein, 15 aa, Dengue virus
ISQHNHRPGYHTQTA

SEQ ID NO: 612 - protein, 15 aa, Dengue virus
TVVITENCGTRGPSL

SEQ ID NO: 613 - protein, 15 aa, Dengue virus
GPSLRTTTVSGKLIH

SEQ ID NO: 614 - protein, 15 aa, Dengue virus
KFQPESPARLASAIL

SEQ ID NO: 615 - protein, 15 aa, Dengue virus
TKGKRALTPPVSDLK

SEQ ID NO: 616 - protein, 15 aa, Dengue virus
GKAKIFTPEARNSTF

SEQ ID NO: 617 - protein, 15 aa, Dengue virus
LIDGPDTSECPNERR

SEQ ID NO: 618 - protein, 15 aa, Dengue virus
WIESSKNQTWQIEKA

SEQ ID NO: 619 - protein, 15 aa, Dengue virus
LIPKSYAGPFSQHNY

SEQ ID NO: 620 - protein, 15 aa, Dengue virus
HNYRQGYATQTVGPW

SEQ ID NO: 621 - protein, 15 aa, Dengue virus
TIQEDCDHRGPSLRT

SEQ ID NO: 622 - protein, 15 aa, West Nile virus
RYKYYPETPQGLAKI

SEQ ID NO: 623 - protein, 15 aa, West Nile virus
GMYKSAPKRLTATTE

SEQ ID NO: 624 - protein, 15 aa, West Nile virus
GPETKECPTQNRAWN

SEQ ID NO: 625 - protein, 15 aa, West Nile virus
KVRESNTTECDSKII

SEQ ID NO: 626 - protein, 15 aa, West Nile virus
HNRRPGYKTQNQGPW

SEQ ID NO: 627 - protein, 15 aa, West Nile virus
GYKTQNQGPWDEGRV

SEQ ID NO: 628 - protein, 15 aa, West Nile virus
SCGHRGPATRTTTES

SEQ ID NO: 629 - protein, 15 aa, West Nile virus
PATRTTTESGKLITD

SEQ ID NO: 630 - protein, 15 aa, Yellow fever virus
LNKYSYYPEDPVKLA

SEQ ID NO: 631 - protein, 15 aa, Yellow fever virus
IIDGKSRKECPFSNR

SEQ ID NO: 632 - protein, 15 aa, Yellow fever virus
AVNGKKSAHGSPTFW

SEQ ID NO: 633 - protein, 15 aa, Yellow fever virus
LTHTIGTSVEESEMF

SEQ ID NO: 634 - protein, 15 aa, Yellow fever virus
PGYKVQTNGPWMQVP

SEQ ID NO: 635 - protein, 15 aa, Yellow fever virus
GNCDGRGKSTRSTTD

SEQ ID NO: 636 - protein, 15 aa, Yellow fever virus
GKSTRSTTDSGKVIP

SEQ ID NO: 637 - protein, 15 aa, Yellow fever virus
PMEIRPRKTHESHLV

SEQ ID NO: 638 - protein, 15 aa, Zika virus
VDFSKKETRCGTGVF

SEQ ID NO: 639 - protein, 15 aa, Zika virus
DRYKYHPDSPRRLAA

SEQ ID NO: 640 - protein, 15 aa, Zika virus
HFVRAAKTNNSFVVD

SEQ ID NO: 641 - protein, 15 aa, Zika virus
GTAVKGKEAVHSDLG

SEQ ID NO: 642 - protein, 15 aa, Zika virus
WIESEKNDTWRLKRA

SEQ ID NO: 643 - protein, 15 aa, Zika virus
LSHHNTREGYRTQMK

SEQ ID NO: 644 - protein, 15 aa, Zika virus
TKVHVEETCGTRGPS

SEQ ID NO: 645 - protein, 15 aa, Zika virus
GPSLRSTTASGRVIE

SEQ ID NO: 646 - protein, 15 aa, Zika virus
MEIRPRKEPESNLVR

SEQ ID NO: 647 - protein, 5 aa, Dengue virus
DSPKR

SEQ ID NO: 648 - protein, 5 aa, Dengue virus
MIRPQ

SEQ ID NO: 649 - protein, 5 aa, Dengue virus
TPECP

SEQ ID NO: 650 - protein, 5 aa, Dengue virus
CPDGQ

SEQ ID NO: 651 - protein, 5 aa, Dengue virus
KDSKA

SEQ ID NO: 652 - protein, 5 aa, Dengue virus
EKNET

SEQ ID NO: 653 - protein, 5 aa, Dengue virus
NRGPS

SEQ ID NO: 654 - protein, 5 aa, Dengue virus
TTTVT

SEQ ID NO: 655 - protein, 5 aa, Dengue virus
SPSKL

SEQ ID NO: 656 - protein, 5 aa, Dengue virus
LRPQP

SEQ ID NO: 657 - protein, 5 aa, Dengue virus
STESH

SEQ ID NO: 658 - protein, 5 aa, Dengue virus
AECPN

SEQ ID NO: 659 - protein, 5 aa, Dengue virus
DNRAV

SEQ ID NO: 660 - protein, 5 aa, Dengue virus
FAGPV

SEQ ID NO: 661 - protein, 5 aa, Dengue virus
HTQTA

SEQ ID NO: 662 - protein, 5 aa, Dengue virus
DCGNR

SEQ ID NO: 663 - protein, 5 aa, Dengue virus
ADSPK

SEQ ID NO: 664 - protein, 5 aa, Dengue virus
RTLTP

SEQ ID NO: 665 - protein, 5 aa, Dengue virus
NTPEC

SEQ ID NO: 666 - protein, 5 aa, Dengue virus
KDERA

SEQ ID NO: 667 - protein, 5 aa, Dengue virus
KNGSW

SEQ ID NO: 668 - protein, 5 aa, Dengue virus
HRPGY

SEQ ID NO: 669 - protein, 5 aa, Dengue virus
ENCGT

SEQ ID NO: 670 - protein, 5 aa, Dengue virus
TTTVS

SEQ ID NO: 671 - protein, 5 aa, Dengue virus
SPARL

SEQ ID NO: 672 - protein, 5 aa, Dengue virus
ALTPP

SEQ ID NO: 673 - protein, 5 aa, Dengue virus
FTPEA

SEQ ID NO: 674 - protein, 5 aa, Dengue virus
DTSEC

SEQ ID NO: 675 - protein, 5 aa, Dengue virus
KNQTW

SEQ ID NO: 676 - protein, 5 aa, Dengue virus
YAGPF

SEQ ID NO: 677 - protein, 5 aa, Dengue virus
GYATQ

SEQ ID NO: 678 - protein, 5 aa, Dengue virus
CDHRG

SEQ ID NO: 679 - protein, 5 aa, West Nile virus
PETPQ

SEQ ID NO: 680 - protein, 5 aa, West Nile virus
APKRL

SEQ ID NO: 681 - protein, 5 aa, West Nile virus
ECPTQ

SEQ ID NO: 682 - protein, 5 aa, West Nile virus
NTTEC

SEQ ID NO: 683 - protein, 5 aa, West Nile virus
GYKTQ

SEQ ID NO: 684 - protein, 5 aa, West Nile virus
NQGPW

SEQ ID NO: 685 - protein, 5 aa, West Nile virus
GPATR

SEQ ID NO: 686 - protein, 5 aa, West Nile virus
TTESG

SEQ ID NO: 687 - protein, 5 aa, Yellow fever virus
YYPED

SEQ ID NO: 688 - protein, 5 aa, Yellow fever virus
SRKEC

SEQ ID NO: 689 - protein, 5 aa, Yellow fever virus
KSAHG

SEQ ID NO: 690 - protein, 5 aa, Yellow fever virus
GTSVE

SEQ ID NO: 691 - protein, 5 aa, Yellow fever virus
QTNGP

SEQ ID NO: 692 - protein, 5 aa, Yellow fever virus
RGKST

SEQ ID NO: 693 - protein, 5 aa, Yellow fever virus
STTDS

SEQ ID NO: 694 - protein, 5 aa, Yellow fever virus
PRKTH

SEQ ID NO: 695 - protein, 5 aa, Zika virus
KETRC

SEQ ID NO: 696 - protein, 5 aa, Zika virus
HPDSP

SEQ ID NO: 697 - protein, 5 aa, Zika virus
AKTNN

SEQ ID NO: 698 - protein, 5 aa, Zika virus
GKEAV

SEQ ID NO: 699 - protein, 5 aa, Zika virus
KNDTW

SEQ ID NO: 700 - protein, 5 aa, Zika virus
TREGY

SEQ ID NO: 701 - protein, 5 aa, Zika virus
EETCG

SEQ ID NO: 702 - protein, 5 aa, Zika virus
STTAS

SEQ ID NO: 703 - protein, 5 aa, Zika virus
RKEPE

SEQ ID NO: 704 - protein, 5 aa, Zika virus
KEKKR

SEQ ID NO: 705 - protein, 5 aa, Zika virus
ASDSR

SEQ ID NO: 706 - protein, 5 aa, Zika virus
SRCPT

SEQ ID NO: 707 - protein, 5 aa, Zika virus
CPTQG

SEQ ID NO: 708 - protein, 5 aa, Zika virus
PTQGE

SEQ ID NO: 709 - protein, 5 aa, Zika virus
TQGEA

SEQ ID NO: 710 - protein, 5 aa, Zika virus
DKQSD

SEQ ID NO: 711 - protein, 5 aa, Zika virus
QSDTQ

SEQ ID NO: 712 - protein, 5 aa, Zika virus
KMTGK

SEQ ID NO: 713 - protein, 5 aa, Zika virus
NDTGH

SEQ ID NO: 714 - protein, 5 aa, Zika virus
ETDEN

SEQ ID NO: 715 - protein, 5 aa, Zika virus
TDENR

SEQ ID NO: 716 - protein, 5 aa, Zika virus
NSPRA

SEQ ID NO: 717 - protein, 5 aa, Zika virus
SPRAE

SEQ ID NO: 718 - protein, 5 aa, Zika virus
RAEAT

SEQ ID NO: 719 - protein, 5 aa, Zika virus
AGADT

SEQ ID NO: 720 - protein, 5 aa, Zika virus
GADTG

SEQ ID NO: 721 - protein, 5 aa, Zika virus
ADTGT

SEQ ID NO: 722 - protein, 5 aa, Zika virus
DTGTP

SEQ ID NO: 723 - protein, 5 aa, Zika virus
GAKGR

SEQ ID NO: 724 - protein, 5 aa, Zika virus
KGRLS

SEQ ID NO: 725 - protein, 5 aa, Zika virus
ASDSR

SEQ ID NO: 726 - protein, 5 aa, Zika virus
AGTDG

SEQ ID NO: 727 - protein, 5 aa, Zika virus
GTDGP

SEQ ID NO: 728 - protein, 5 aa, Zika virus
TDGPC

SEQ ID NO: 729 - protein, 5 aa, Zika virus
DGPCK

SEQ ID NO: 730 - protein, 5 aa, Zika virus
ITEST

SEQ ID NO: 731 - protein, 5 aa, Zika virus
TESTE

SEQ ID NO: 732 - protein, 5 aa, Zika virus
ESTEN

SEQ ID NO: 733 - protein, 5 aa, Zika virus
STENS

SEQ ID NO: 734 - protein, 5 aa, Zika virus
TENSK

SEQ ID NO: 735 - protein, 5 aa, Zika virus
GSTIG

SEQ ID NO: 736 - protein, 5 aa, Zika virus
NTKNG

SEQ ID NO: 737 - protein, 5 aa, Zika virus
TKNGS

SEQ ID NO: 738 - protein, 5 aa, Zika virus
AGTDG

SEQ ID NO: 739 - protein, 5 aa, Zika virus
SKKET

SEQ ID NO: 740 - protein, 5 aa, Zika virus
KKETR

SEQ ID NO: 741 - protein, 5 aa, Zika virus
YHPDS

SEQ ID NO: 742 - protein, 5 aa, Zika virus
HPDSP

SEQ ID NO: 743 - protein, 5 aa, Zika virus
DSPRR

SEQ ID NO: 744 - protein, 5 aa, Zika virus
AKTNN

SEQ ID NO: 745 - protein, 5 aa, Zika virus
KTNNS

SEQ ID NO: 746 - protein, 5 aa, Zika virus
KGKEA

SEQ ID NO: 747 - protein, 5 aa, Zika virus
SEKND

SEQ ID NO: 748 - protein, 5 aa, Zika virus
EKNDT

SEQ ID NO: 749 - protein, 5 aa, Zika virus
NTREG

SEQ ID NO: 750 - protein, 5 aa, Zika virus
GTRGP

SEQ ID NO: 751 - protein, 5 aa, Zika virus
TRGPS

SEQ ID NO: 752 - protein, 5 aa, Zika virus
LRSTT

SEQ ID NO: 753 - protein, 5 aa, Zika virus
STTAS

SEQ ID NO: 754 - protein, 5 aa, Zika virus
TTASG

SEQ ID NO: 755 - protein, 5 aa, Zika virus
TASGR

SEQ ID NO: 756 - protein, 5 aa, Zika virus
RPRKE

SEQ ID NO: 757 - protein, 5 aa, Zika virus
KEPES

SEQ ID NO: 758 - protein, 5 aa, Zika virus
EPESN

SEQ ID NO: 759 - protein, 5 aa, West Nile virus
KDKPT

SEQ ID NO: 760 - protein, 5 aa, West Nile virus
NEKRA

SEQ ID NO: 761 - protein, 5 aa, West Nile virus
EKRAD

SEQ ID NO: 762 - protein, 5 aa, West Nile virus
KRADP

SEQ ID NO: 763 - protein, 5 aa, West Nile virus
TTVES

SEQ ID NO: 764 - protein, 5 aa, West Nile virus
GKIGA

SEQ ID NO: 765 - protein, 5 aa, West Nile virus
ITPSA

SEQ ID NO: 766 - protein, 5 aa, West Nile virus
TPSAP

SEQ ID NO: 767 - protein, 5 aa, West Nile virus
PSAPS

SEQ ID NO: 768 - protein, 5 aa, West Nile virus
EPRSG

SEQ ID NO: 769 - protein, 5 aa, West Nile virus
SSAGS

SEQ ID NO: 770 - protein, 5 aa, West Nile virus
SAGST

SEQ ID NO: 771 - protein, 5 aa, West Nile virus
AGSTT

SEQ ID NO: 772 - protein, 5 aa, West Nile virus
GSQEG

SEQ ID NO: 773 - protein, 5 aa, West Nile virus
SQEGA

SEQ ID NO: 774 - protein, 5 aa, West Nile virus
ARTPA

SEQ ID NO: 775 - protein, 5 aa, West Nile virus
PADTG

SEQ ID NO: 776 - protein, 5 aa, West Nile virus
DTGHG

SEQ ID NO: 777 - protein, 5 aa, West Nile virus
GTDGP

SEQ ID NO: 778 - protein, 5 aa, West Nile virus
TDGPC

SEQ ID NO: 779 - protein, 5 aa, West Nile virus
KSGSS

SEQ ID NO: 780 - protein, 5 aa, West Nile virus
SGSSI

SEQ ID NO: 781 - protein, 5 aa, West Nile virus
GSSIG

SEQ ID NO: 782 - protein, 5 aa, Dengue virus
KNKPT

SEQ ID NO: 783 - protein, 5 aa, Dengue virus
KPTLD

SEQ ID NO: 784 - protein, 5 aa, Dengue virus
KTEAT

SEQ ID NO: 785 - protein, 5 aa, Dengue virus
SRCPT

SEQ ID NO: 786 - protein, 5 aa, Dengue virus
CPTQG

SEQ ID NO: 787 - protein, 5 aa, Dengue virus
PTQGE

SEQ ID NO: 788 - protein, 5 aa, Dengue virus
PEEQD

SEQ ID NO: 789 - protein, 5 aa, Dengue virus
EEQDQ

SEQ ID NO: 790 - protein, 5 aa, Dengue virus
QVGNE

SEQ ID NO: 791 - protein, 5 aa, Dengue virus
NETQG

SEQ ID NO: 792 - protein, 5 aa, Dengue virus
PQAST

SEQ ID NO: 793 - protein, 5 aa, Dengue virus
QASTT

SEQ ID NO: 794 - protein, 5 aa, Dengue virus
ASTTE

SEQ ID NO: 795 - protein, 5 aa, Dengue virus
TSGAT

SEQ ID NO: 796 - protein, 5 aa, Dengue virus
SGATT

SEQ ID NO: 797 - protein, 5 aa, Dengue virus
GATTE

SEQ ID NO: 798 - protein, 5 aa, Dengue virus
ATTET

SEQ ID NO: 799 - protein, 5 aa, Dengue virus
TTETP

SEQ ID NO: 800 - protein, 5 aa, Dengue virus
TETPT

SEQ ID NO: 801 - protein, 5 aa, Dengue virus
QNSGG

SEQ ID NO: 802 - protein, 5 aa, Dengue virus
NSGGT

SEQ ID NO: 803 - protein, 5 aa, Dengue virus
SGGTS

SEQ ID NO: 804 - protein, 5 aa, Dengue virus
VSETQ

SEQ ID NO: 805 - protein, 5 aa, Dengue virus
SETQH

SEQ ID NO: 806 - protein, 5 aa, Dengue virus
YKGED

SEQ ID NO: 807 - protein, 5 aa, Dengue virus
KGEDA

SEQ ID NO: 808 - protein, 5 aa, Dengue virus
GEDAP

SEQ ID NO: 809 - protein, 5 aa, Dengue virus
STEDG

SEQ ID NO: 810 - protein, 5 aa, Dengue virus
TEDGQ

SEQ ID NO: 811 - protein, 5 aa, Dengue virus
EDGQG

SEQ ID NO: 812 - protein, 5 aa, Dengue virus
DGQGK

SEQ ID NO: 813 - protein, 5 aa, Dengue virus
QGKAH

SEQ ID NO: 814 - protein, 5 aa, Dengue virus
TKKEE

SEQ ID NO: 815 - protein, 5 aa, Dengue virus
KKEEP

SEQ ID NO: 816 - protein, 5 aa, Dengue virus
EAEPP

SEQ ID NO: 817 - protein, 5 aa, Dengue virus
EPPFG

SEQ ID NO: 818 - protein, 5 aa, Dengue virus
KKGSS

SEQ ID NO: 819 - protein, 5 aa, Dengue virus
GSSIG

SEQ ID NO: 820 - protein, 5 aa, Dengue virus
NSKNT

SEQ ID NO: 821 - protein, 5 aa, Dengue virus
SKNTS

SEQ ID NO: 822 - protein, 5 aa, Dengue virus
KNTSM

SEQ ID NO: 823 - protein, 5 aa, Dengue virus
QGKPT

SEQ ID NO: 824 - protein, 5 aa, Dengue virus
TKTTA

SEQ ID NO: 825 - protein, 5 aa, Dengue virus
KTTAK

SEQ ID NO: 826 - protein, 5 aa, Dengue virus
TTAKE

SEQ ID NO: 827 - protein, 5 aa, Dengue virus
CPTQG

SEQ ID NO: 828 - protein, 5 aa, Dengue virus
PTQGE

SEQ ID NO: 829 - protein, 5 aa, Dengue virus
TQGEP

SEQ ID NO: 830 - protein, 5 aa, Dengue virus
LKEEQ

SEQ ID NO: 831 - protein, 5 aa, Dengue virus
KEEQD

SEQ ID NO: 832 - protein, 5 aa, Dengue virus
EEQDQ

SEQ ID NO: 833 - protein, 5 aa, Dengue virus
GDTHA

SEQ ID NO: 834 - protein, 5 aa, Dengue virus
GNDTS

SEQ ID NO: 835 - protein, 5 aa, Dengue virus
TPRSP

SEQ ID NO: 836 - protein, 5 aa, Dengue virus
PRSPS

SEQ ID NO: 837 - protein, 5 aa, Dengue virus
AGADT

SEQ ID NO: 838 - protein, 5 aa, Dengue virus
SQEGA

SEQ ID NO: 839 - protein, 5 aa, Dengue virus
AGATE

SEQ ID NO: 840 - protein, 5 aa, Dengue virus
GATEV

SEQ ID NO: 841 - protein, 5 aa, Dengue virus
VDSGD

SEQ ID NO: 842 - protein, 5 aa, Dengue virus
DSGDG

SEQ ID NO: 843 - protein, 5 aa, Dengue virus
SGDGN

SEQ ID NO: 844 - protein, 5 aa, Dengue virus
GDGNH

SEQ ID NO: 845 - protein, 5 aa, Dengue virus
AETQH

SEQ ID NO: 846 - protein, 5 aa, Dengue virus
EGAGA

SEQ ID NO: 847 - protein, 5 aa, Dengue virus
AENTN

SEQ ID NO: 848 - protein, 5 aa, Dengue virus
NTNSV

SEQ ID NO: 849 - protein, 5 aa, Dengue virus
EPPFG

SEQ ID NO: 850 - protein, 5 aa, Dengue virus
NSRNT

SEQ ID NO: 851 - protein, 5 aa, Dengue virus
SRNTS

SEQ ID NO: 852 - protein, 5 aa, Yellow fever virus
DKPSL

SEQ ID NO: 853 - protein, 5 aa, Yellow fever virus
DRPAE

SEQ ID NO: 854 - protein, 5 aa, Yellow fever virus
PSTGE

SEQ ID NO: 855 - protein, 5 aa, Yellow fever virus
STGEA

SEQ ID NO: 856 - protein, 5 aa, Yellow fever virus
AEENE

SEQ ID NO: 857 - protein, 5 aa, Yellow fever virus
EENEG

SEQ ID NO: 858 - protein, 5 aa, Yellow fever virus
ENEGD

SEQ ID NO: 859 - protein, 5 aa, Yellow fever virus
NEGDN

SEQ ID NO: 860 - protein, 5 aa, Yellow fever virus
TYSDR

SEQ ID NO: 861 - protein, 5 aa, Yellow fever virus
AKQEN

SEQ ID NO: 862 - protein, 5 aa, Yellow fever virus
ALSGS

SEQ ID NO: 863 - protein, 5 aa, Yellow fever virus
LSGSQ

SEQ ID NO: 864 - protein, 5 aa, Yellow fever virus
SGSQE

SEQ ID NO: 865 - protein, 5 aa, Yellow fever virus
QSGSG

SEQ ID NO: 866 - protein, 5 aa, Yellow fever virus
SGSGG

SEQ ID NO: 867 - protein, 5 aa, Yellow fever virus
GSGGV

SEQ ID NO: 868 - protein, 5 aa, Yellow fever virus
GNQEG

SEQ ID NO: 869 - protein, 5 aa, Yellow fever virus
NQEGS

SEQ ID NO: 870 - protein, 5 aa, Yellow fever virus
QEGSL

SEQ ID NO: 871 - protein, 5 aa, Yellow fever virus
VTKDT

SEQ ID NO: 872 - protein, 5 aa, Yellow fever virus
TKDTN

SEQ ID NO: 873 - protein, 5 aa, Yellow fever virus
KDTND

SEQ ID NO: 874 - protein, 5 aa, Yellow fever virus
DTNDN

SEQ ID NO: 875 - protein, 5 aa, Yellow fever virus
TNDNN

SEQ ID NO: 876 - protein, 5 aa, Yellow fever virus
KNPTD

SEQ ID NO: 877 - protein, 5 aa, Yellow fever virus
NPTDT

SEQ ID NO: 878 - protein, 5 aa, Yellow fever virus
DTGHG

SEQ ID NO: 879 - protein, 5 aa, Yellow fever virus
TGHGT

SEQ ID NO: 880 - protein, 5 aa, Yellow fever virus
SKGAP

SEQ ID NO: 881 - protein, 5 aa, Yellow fever virus
KGAPC

SEQ ID NO: 882 - protein, 5 aa, Yellow fever virus
ASTND

SEQ ID NO: 883 - protein, 5 aa, Yellow fever virus
STNDD

SEQ ID NO: 884 - protein, 5 aa, Yellow fever virus
NPPFG

SEQ ID NO: 885 - protein, 5 aa, Yellow fever virus
HKEGS

SEQ ID NO: 886 - protein, 5 aa, Yellow fever virus
KEGSS

SEQ ID NO: 887 - protein, 5 aa, Yellow fever virus
GSSIG

SEQ ID NO: 888 - protein, 5 aa, Dengue virus
KNKPT

SEQ ID NO: 889 - protein, 5 aa, Dengue virus
EAKQP

SEQ ID NO: 890 - protein, 5 aa, Dengue virus
TTTES

SEQ ID NO: 891 - protein, 5 aa, Dengue virus
TTESR

SEQ ID NO: 892 - protein, 5 aa, Dengue virus
SRCPT

SEQ ID NO: 893 - protein, 5 aa, Dengue virus
CPTQG

SEQ ID NO: 894 - protein, 5 aa, Dengue virus
PTQGE

SEQ ID NO: 895 - protein, 5 aa, Dengue virus
TQGEP

SEQ ID NO: 896 - protein, 5 aa, Dengue virus
QGEPS

SEQ ID NO: 897 - protein, 5 aa, Dengue virus
NEEQD

SEQ ID NO: 898 - protein, 5 aa, Dengue virus
EEQDK

SEQ ID NO: 899 - protein, 5 aa, Dengue virus
SGEEH

SEQ ID NO: 900 - protein, 5 aa, Dengue virus
GEEHA

SEQ ID NO: 901 - protein, 5 aa, Dengue virus
GNDTG

SEQ ID NO: 902 - protein, 5 aa, Dengue virus
NDTGK

SEQ ID NO: 903 - protein, 5 aa, Dengue virus
DTGKH

SEQ ID NO: 904 - protein, 5 aa, Dengue virus
TGKHG

SEQ ID NO: 905 - protein, 5 aa, Dengue virus
GKHGK

SEQ ID NO: 906 - protein, 5 aa, Dengue virus
KHGKE

SEQ ID NO: 907 - protein, 5 aa, Dengue virus
TPQSS

SEQ ID NO: 908 - protein, 5 aa, Dengue virus
PQSST

SEQ ID NO: 909 - protein, 5 aa, Dengue virus
QSSTT

SEQ ID NO: 910 - protein, 5 aa, Dengue virus
SSTTE

SEQ ID NO: 911 - protein, 5 aa, Dengue virus
STTEA

SEQ ID NO: 912 - protein, 5 aa, Dengue virus
TTEAE

SEQ ID NO: 913 - protein, 5 aa, Dengue virus
GADTQ

SEQ ID NO: 914 - protein, 5 aa, Dengue virus
ADTQG

SEQ ID NO: 915 - protein, 5 aa, Dengue virus
DTQGS

SEQ ID NO: 916 - protein, 5 aa, Dengue virus
TQGSN

SEQ ID NO: 917 - protein, 5 aa, Dengue virus
PHAKK

SEQ ID NO: 918 - protein, 5 aa, Dengue virus
AETQH

SEQ ID NO: 919 - protein, 5 aa, Dengue virus
YEGDG

SEQ ID NO: 920 - protein, 5 aa, Dengue virus
EGDGS

SEQ ID NO: 921 - protein, 5 aa, Dengue virus
GDGSP

SEQ ID NO: 922 - protein, 5 aa, Dengue virus
DGSPC

SEQ ID NO: 923 - protein, 5 aa, Dengue virus
TEKDS

SEQ ID NO: 924 - protein, 5 aa, Dengue virus
EKDSP

SEQ ID NO: 925 - protein, 5 aa, Dengue virus
DSPVN

SEQ ID NO: 926 - protein, 5 aa, Dengue virus
EAEPP

SEQ ID NO: 927 - protein, 5 aa, Dengue virus
EPPFG

SEQ ID NO: 928 - protein, 5 aa, Dengue virus
PPFGD

SEQ ID NO: 929 - protein, 5 aa, Dengue virus
GSSIG

SEQ ID NO: 930 - protein, 5 aa, Dengue virus
SRSTS

SEQ ID NO: 931 - protein, 5 aa, Dengue virus
RSTSL

SEQ ID NO: 932 - protein, 5 aa, Dengue virus
KNKPT

SEQ ID NO: 933 - protein, 5 aa, Dengue virus
ISNTT

SEQ ID NO: 934 - protein, 5 aa, Dengue virus
SNTTT

SEQ ID NO: 935 - protein, 5 aa, Dengue virus
NTTTD

SEQ ID NO: 936 - protein, 5 aa, Dengue virus
TTTDS

SEQ ID NO: 937 - protein, 5 aa, Dengue virus
TTDSR

SEQ ID NO: 938 - protein, 5 aa, Dengue virus
SRCPT

SEQ ID NO: 939 - protein, 5 aa, Dengue virus
CPTQG

SEQ ID NO: 940 - protein, 5 aa, Dengue virus
PTQGE

SEQ ID NO: 941 - protein, 5 aa, Dengue virus
TQGEA

SEQ ID NO: 942 - protein, 5 aa, Dengue virus
QVGNE

SEQ ID NO: 943 - protein, 5 aa, Dengue virus
GNETT

SEQ ID NO: 944 - protein, 5 aa, Dengue virus
NETTE

SEQ ID NO: 945 - protein, 5 aa, Dengue virus
TEHGT

SEQ ID NO: 946 - protein, 5 aa, Dengue virus
APTSE

SEQ ID NO: 947 - protein, 5 aa, Dengue virus
SPRTG

SEQ ID NO: 948 - protein, 5 aa, Dengue virus
SGAST

SEQ ID NO: 949 - protein, 5 aa, Dengue virus
GASTS

SEQ ID NO: 950 - protein, 5 aa, Dengue virus
ASTSQ

SEQ ID NO: 951 - protein, 5 aa, Dengue virus
STSQE

SEQ ID NO: 952 - protein, 5 aa, Dengue virus
QTSGT

SEQ ID NO: 953 - protein, 5 aa, Dengue virus
SGTTT

SEQ ID NO: 954 - protein, 5 aa, Dengue virus
AETQH

SEQ ID NO: 955 - protein, 5 aa, Dengue virus
YEGTD

SEQ ID NO: 956 - protein, 5 aa, Dengue virus
EGTDA

SEQ ID NO: 957 - protein, 5 aa, Dengue virus
QDEKG

SEQ ID NO: 958 - protein, 5 aa, Dengue virus
DEKGV

SEQ ID NO: 959 - protein, 5 aa, Dengue virus
VTQNG

SEQ ID NO: 960 - protein, 5 aa, Dengue virus
KEKPV

SEQ ID NO: 961 - protein, 5 aa, Dengue virus
ETEPP

SEQ ID NO: 962 - protein, 5 aa, Dengue virus
EPPFG

SEQ ID NO: 963 - protein, 5 aa, Dengue virus
SRSTS

SEQ ID NO: 964 - protein, 5 aa, Dengue virus
RSTSL

SEQ ID NO: 965 - protein, 5 aa, Dengue virus
VTAET

SEQ ID NO: 966 - protein, 5 aa, Dengue virus
TAETQ

SEQ ID NO: 967 - protein, 5 aa, Dengue virus
ETQNS

SEQ ID NO: 968 - protein, 5 aa, Dengue virus
NTPEC

SEQ ID NO: 969 - protein, 5 aa, Dengue virus
TPECP

SEQ ID NO: 970 - protein, 5 aa, Dengue virus
CPSAS

SEQ ID NO: 971 - protein, 5 aa, Dengue virus
SQKNG

SEQ ID NO: 972 - protein, 5 aa, Dengue virus
QKNGS

SEQ ID NO: 973 - protein, 5 aa, Dengue virus
KNGSW

SEQ ID NO: 974 - protein, 5 aa, Dengue virus
GTRGP

SEQ ID NO: 975 - protein, 5 aa, Dengue virus
TRGPS

SEQ ID NO: 976 - protein, 5 aa, Dengue virus
SEKEE

SEQ ID NO: 977 - protein, 5 aa, Dengue virus
EKEEN

SEQ ID NO: 978 - protein, 5 aa, Dengue virus
FQPES

SEQ ID NO: 979 - protein, 5 aa, Dengue virus
PESPA

SEQ ID NO: 980 - protein, 5 aa, Dengue virus
ESPAR

SEQ ID NO: 981 - protein, 5 aa, Dengue virus
TPPVS

SEQ ID NO: 982 - protein, 5 aa, Dengue virus
GPDTS

SEQ ID NO: 983 - protein, 5 aa, Dengue virus
TSECP

SEQ ID NO: 984 - protein, 5 aa, Dengue virus
REGSS

SEQ ID NO: 985 - protein, 5 aa, Dengue virus
EGSSE

SEQ ID NO: 986 - protein, 5 aa, Dengue virus
GSSEV

SEQ ID NO: 987 - protein, 5 aa, Dengue virus
SSKNQ

SEQ ID NO: 988 - protein, 5 aa, Dengue virus
TTTAS

SEQ ID NO: 989 - protein, 5 aa, Dengue virus
TTASG

SEQ ID NO: 990 - protein, 5 aa, Dengue virus
TASGK

SEQ ID NO: 991 - protein, 5 aa, Dengue virus
LSEKE

SEQ ID NO: 992 - protein, 5 aa, Dengue virus
SEKEE

SEQ ID NO: 993 - protein, 5 aa, Dengue virus
EKEEN

SEQ ID NO: 994 - protein, 5 aa, Yellow fever virus
SPGRK

SEQ ID NO: 995 - protein, 5 aa, Yellow fever virus
PGRKN

SEQ ID NO: 996 - protein, 5 aa, Yellow fever virus
GRKNG

SEQ ID NO: 997 - protein, 5 aa, Yellow fever virus
KSRKE

SEQ ID NO: 998 - protein, 5 aa, Yellow fever virus
VNGKK

SEQ ID NO: 999 - protein, 5 aa, Yellow fever virus
NGKKS

SEQ ID NO: 1000 - protein, 5 aa, Yellow fever virus
GKKSA

SEQ ID NO: 1001 - protein, 5 aa, Yellow fever virus
SAHGS

SEQ ID NO: 1002 - protein, 5 aa, Yellow fever virus
AHGSP

SEQ ID NO: 1003 - protein, 5 aa, Yellow fever virus
GGPVS

SEQ ID NO: 1004 - protein, 5 aa, Yellow fever virus
VQTNG

SEQ ID NO: 1005 - protein, 5 aa, Yellow fever virus
GNCDG

SEQ ID NO: 1006 - protein, 5 aa, Yellow fever virus
DGRGK

SEQ ID NO: 1007 - protein, 5 aa, Yellow fever virus
GRGKS

SEQ ID NO: 1008 - protein, 5 aa, Yellow fever virus
RGKST

SEQ ID NO: 1009 - protein, 5 aa, Yellow fever virus
GKSTR

SEQ ID NO: 1010 - protein, 5 aa, Yellow fever virus
KSTRS

SEQ ID NO: 1011 - protein, 5 aa, Yellow fever virus
STRST

SEQ ID NO: 1012 - protein, 5 aa, Yellow fever virus
TRSTT

SEQ ID NO: 1013 - protein, 5 aa, Yellow fever virus
STTDS

SEQ ID NO: 1014 - protein, 5 aa, Yellow fever virus
TTDSG

SEQ ID NO: 1015 - protein, 5 aa, Yellow fever virus
TDSGK

SEQ ID NO: 1016 - protein, 5 aa, Yellow fever virus
DSGKV

SEQ ID NO: 1017 - protein, 5 aa, Yellow fever virus
RKTHE

SEQ ID NO: 1018 - protein, 5 aa, Yellow fever virus
PETPQ

SEQ ID NO: 1019 - protein, 5 aa, West Nile virus
ETPQG

SEQ ID NO: 1020 - protein, 5 aa, West Nile virus
APKRL

SEQ ID NO: 1021 - protein, 5 aa, West Nile virus
PETKE

SEQ ID NO: 1022 - protein, 5 aa, West Nile virus
CPTQN

SEQ ID NO: 1023 - protein, 5 aa, West Nile virus
RESNT

SEQ ID NO: 1024 - protein, 5 aa, West Nile virus
ESNTT

SEQ ID NO: 1025 - protein, 5 aa, West Nile virus
SNTTE

SEQ ID NO: 1026 - protein, 5 aa, West Nile virus
AGPRS

SEQ ID NO: 1027 - protein, 5 aa, West Nile virus
RSNHN

SEQ ID NO: 1028 - protein, 5 aa, West Nile virus
RGPAT

SEQ ID NO: 1029 - protein, 5 aa, West Nile virus
ATRTT

SEQ ID NO: 1030 - protein, 5 aa, West Nile virus
TRTTT

SEQ ID NO: 1031 - protein, 5 aa, West Nile virus
RTTTE

SEQ ID NO: 1032 - protein, 5 aa, West Nile virus
TTTES

SEQ ID NO: 1033 - protein, 5 aa, West Nile virus
TTESG

SEQ ID NO: 1034 - protein, 5 aa, West Nile virus
TESGK

SEQ ID NO: 1035 - protein, 5 aa, Dengue virus
DSPKR

SEQ ID NO: 1036 - protein, 5 aa, Dengue virus
GPDTP

SEQ ID NO: 1037 - protein, 5 aa, Dengue virus
TPECP

SEQ ID NO: 1038 - protein, 5 aa, Dengue virus
ECPDG

SEQ ID NO: 1039 - protein, 5 aa, Dengue virus
SEKNE

SEQ ID NO: 1040 - protein, 5 aa, Dengue virus
EKNET

SEQ ID NO: 1041 - protein, 5 aa, Dengue virus
NRGPS

SEQ ID NO: 1042 - protein, 5 aa, Dengue virus
VKEKE

SEQ ID NO: 1043 - protein, 5 aa, Dengue virus
KEKEE

SEQ ID NO: 1044 - protein, 5 aa, Dengue virus
EKEEN

SEQ ID NO: 1045 - protein, 5 aa, Dengue virus
FQPES

SEQ ID NO: 1046 - protein, 5 aa, Dengue virus
PESPS

SEQ ID NO: 1047 - protein, 5 aa, Dengue virus
ESPSK

SEQ ID NO: 1048 - protein, 5 aa, Dengue virus
SPSKL

SEQ ID NO: 1049 - protein, 5 aa, Dengue virus
GKRSL

SEQ ID NO: 1050 - protein, 5 aa, Dengue virus
STESH

SEQ ID NO: 1051 - protein, 5 aa, Dengue virus
TESHN

SEQ ID NO: 1052 - protein, 5 aa, Dengue virus
PETAE

SEQ ID NO: 1053 - protein, 5 aa, Dengue virus
PNTNR

SEQ ID NO: 1054 - protein, 5 aa, Dengue virus
NRGPS

SEQ ID NO: 1055 - protein, 5 aa, Dengue virus
TTTAS

SEQ ID NO: 1056 - protein, 5 aa, Dengue virus
TTASG

SEQ ID NO: 1057 - protein, 5 aa, Dengue virus
TASGK

SEQ ID NO: 1058 - protein, 15 aa, Plasmodium falciparum
SGEPQTQGEASSPSD

SEQ ID NO: 1059 - protein, 15 aa, Plasmodium falciparum
KELNSDKQSDKYISD

SEQ ID NO: 1060 - protein, 15 aa, Plasmodium falciparum
DEKKKKMTGKEEQII

SEQ ID NO: 1061 - protein, 15 aa, Plasmodium falciparum
EKKKKMTGKEEQIIV

SEQ ID NO: 1062 - protein, 15 aa, Plasmodium falciparum
GYINLETDENGYKKT

SEQ ID NO: 1063 - protein, 15 aa, Plasmodium falciparum
DSSLFTDENREEKKD

SEQ ID NO: 1064 - protein, 15 aa, Plasmodium falciparum
GGSNIRAEATGYGVV

SEQ ID NO: 1065 - protein, 15 aa, Plasmodium falciparum
RPTQDADTGTDDIDD

SEQ ID NO: 1066 - protein, 15 aa, Plasmodium falciparum
TITNDKGRLSQDEID

SEQ ID NO: 1067 - protein, 15 aa, Plasmodium falciparum
ELSGEGRLSSTGMYK

SEQ ID NO: 1068 - protein, 15 aa, Plasmodium falciparum
EDKGGAGTDGELSHN

SEQ ID NO: 1069 - protein, 15 aa, Plasmodium falciparum
SRGTPTDGPCEGKGD

SEQ ID NO: 1070 - protein, 15 aa, Plasmodium falciparum
LERLKDGPCKNDSEE

SEQ ID NO: 1071 - protein, 15 aa, Plasmodium falciparum
DTRDKTESTENKVLS

SEQ ID NO: 1072 - protein, 15 aa, Plasmodium falciparum
DELIEESTENLNSQH

SEQ ID NO: 1073 - protein, 15 aa, Plasmodium falciparum
TNIEWSTENSKTNTT

SEQ ID NO: 1074 - protein, 15 aa, Plasmodium falciparum
NIEWSTENSKTNTTN

SEQ ID NO: 1075 - protein, 15 aa, Plasmodium falciparum
KNEQVENSKMENGNK

SEQ ID NO: 1076 - protein, 15 aa, Plasmodium falciparum
FKGLSSKKETEEYVS

SEQ ID NO: 1077 - protein, 15 aa, Plasmodium falciparum
ICKGIEKKETRRWKR

SEQ ID NO: 1078 - protein, 15 aa, Plasmodium falciparum
DLSKQYHPDSNKNCK

SEQ ID NO: 1079 - protein, 15 aa, Plasmodium falciparum
NKNKEKTNNSKSDGS

SEQ ID NO: 1080 - protein, 15 aa, Plasmodium falciparum
RETYDKGKEAKSKRS

SEQ ID NO: 1081 - protein, 15 aa, Plasmodium falciparum
YAACDESEKNVEEHP

SEQ ID NO: 1082 - protein, 15 aa, Plasmodium falciparum
FENEKSEKNDNYINV

SEQ ID NO: 1083 - protein, 15 aa, Plasmodium falciparum
NKKNIEKNDTCNNNN

SEQ ID NO: 1084 - protein, 15 aa, Plasmodium falciparum
IDISLTNTREGQNYL

SEQ ID NO: 1085 - protein, 15 aa, Plasmodium falciparum
FMQERRTQMKEEKSN

SEQ ID NO: 1086 - protein, 15 aa, Plasmodium falciparum
KQNNNTQMKGKQNNN

SEQ ID NO: 1087 - protein, 15 aa, Plasmodium falciparum
NNNTNQMKGPPGQMN

SEQ ID NO: 1088 - protein, 15 aa, Plasmodium falciparum
PSGNNTTASGKNTPS

SEQ ID NO: 1089 - protein, 15 aa, Plasmodium falciparum
DIIYKIRPRKENKNV

SEQ ID NO: 1090 - protein, 15 aa, Plasmodium falciparum
EILHSKEPESDYVEA

SEQ ID NO: 1091 - protein, 15 aa, Plasmodium falciparum
SSSKMEPESNRYIKG

SEQ ID NO: 1092 - protein, 16 aa, Plasmodium falciparum
TNIEWSTENSKTNTTN

SEQ ID NO: 1093 - protein, 16 aa, Plasmodium falciparum
DEKKKKMTGKEEQIIV

SEQ ID NO: 1094 - DNA, 255 bp, Plasmodium falciparum
atggagacagacacactcctgctatgggtactgctgctctgggttccaggttccactggtgacacgcgttgccgcaagaacaagatcatcaacaagtacctgcacgagatggacatcaccaacatcgagtggtccaccgagaactccaagaccaacaccaccaactccgagtccaagaccaccaccacccgcgagaacaccatcgtgatcaaggagaagatcggcacccacgacgagaagaagaagaagtgctag

SEQ ID NO: 1095 - protein, 84 aa, Plasmodium falciparum
METDTLLLWVLLLWVPGSTGDTRCRKNKIINKYLHEMDITNIEWSTENSKTNTTNSESKTTTTRENTIVIKEKIGTHDEKKKKC

SEQ ID NO: 1096 - DNA, 273 bp, Plasmodium falciparum
atggagacagacacactcctgctatgggtactgctgctctgggttccaggttccactggtgacacgcgtcaccaccatcatcaccattgccgcaagaacaagatcatcaacaagtacctgcacgagatggacatcaccaacatcgagtggtccaccgagaactccaagaccaacaccaccaactccgagtccaagaccaccaccacccgcgagaacaccatcgtgatcaaggagaagatcggcacccacgacgagaagaagaagaagtgctag

SEQ ID NO: 1097 - protein, 90 aa, Plasmodium falciparum
METDTLLLWVLLLWVPGSTGDTRHHHHHHCRKNKIINKYLHEMDITNIEWSTENSKTNTTNSESKTTTTRENTIVIKEKIGTHDEKKKKC

SEQ ID NO: 1098 - DNA, 273 bp, Plasmodium falciparum
atggagacagacacactcctgctatgggtactgctgctctgggttccaggttccactggtgacacgcgttgccgcaagaacaagatcatcaacaagtacctgcacgagatggacatcaccaacatcgagtggtccaccgagaactccaagaccaacaccaccaactccgagtccaagaccaccaccacccgcgagaacaccatcgtgatcaaggagaagatcggcacccacgacgagaagaagaagaagtgccaccaccatcatcaccattag

SEQ ID NO: 1099 - protein, 90 aa, Plasmodium falciparum
METDTLLLWVLLLWVPGSTGDTRCRKNKIINKYLHEMDITNIEWSTENSKTNTTNSESKTTTTRENTIVIKEKIGTHDEKKKKCHHHHHH

SEQ ID NO: 1100 - DNA, 285 bp, Plasmodium falciparum
atggagacagacacactcctgctatgggtactgctgctctgggttccaggttccactggtgacacgcgttgccgcaagaacaagatcatcaacaagtacctgcacgagatggacatcaccaacatcgagtggtccaccgagaactccaagaccaacaccaccaactccgagtccaagaccaccaccacccgcgagaacaccatcgtgatcaagatgatgctggagctggacccccccttcggcgactcctacatcgtgatcggcgtgggcgagaagaagtgctag

SEQ ID NO: 1101 - protein, 94 aa, Plasmodium falciparum
METDTLLLWVLLLWVPGSTGDTRCRKNKIINKYLHEMDITNIEWSTENSKTNTTNSESKTTTTRENTIVIKMMLELDPPFGDSYIVIGVGEKKC

SEQ ID NO: 1102 - DNA, 303 bp, Plasmodium falciparum
atggagacagacacactcctgctatgggtactgctgctctgggttccaggttccactggtgacacgcgtcaccaccatcatcaccattgccgcaagaacaagatcatcaacaagtacctgcacgagatggacatcaccaacatcgagtggtccaccgagaactccaagaccaacaccaccaactccgagtccaagaccaccaccacccgcgagaacaccatcgtgatcaagatgatgctggagctggacccccccttcggcgactcctacatcgtgatcggcgtgggcgagaagaagtgctag

SEQ ID NO: 1103 - protein, 100 aa, Plasmodium falciparum
METDTLLLWVLLLWVPGSTGDTRHHHHHHCRKNKIINKYLHEMDITNIEWSTENSKTNTTNSESKTTTTRENTIVIKMMLELDPPFGDSYIVIGVGEKKC

SEQ ID NO: 1104 - DNA, 303 bp, Plasmodium falciparum
atggagacagacacactcctgctatgggtactgctgctctgggttccaggttccactggtgacacgcgttgccgcaagaacaagatcatcaacaagtacctgcacgagatggacatcaccaacatcgagtggtccaccgagaactccaagaccaacaccaccaactccgagtccaagaccaccaccacccgcgagaacaccatcgtgatcaagatgatgctggagctggacccccccttcggcgactcctacatcgtgatcggcgtgggcgagaagaagtgccaccaccatcatcaccattag

SEQ ID NO: 1105 - protein, 100 aa, Plasmodium falciparum
METDTLLLWVLLLWVPGSTGDTRCRKNKIINKYLHEMDITNIEWSTENSKTNTTNSESKTTTTRENTIVIKMMLELDPPFGDSYIVIGVGEKKCHHHHHH

SEQ ID NO: 1106 - protein, 5 aa, Dengue virus
SLRTT

SEQ ID NO: 1107 - protein, 5 aa, Dengue virus
ASRAW

SEQ ID NO: 1108 - protein, 5 aa, Dengue virus
IDGPS

SEQ ID NO: 1109 - protein, 5 aa, Dengue virus
KGKRA

SEQ ID NO: 1110 - protein, 5 aa, Dengue virus
IFTPE

SEQ ID NO: 1111 - protein, 5 aa, Dengue virus
TTVTG

SEQ ID NO: 1112 - protein, 5 aa, Dengue virus
SLAGP

SEQ ID NO: 1113 - protein, 5 aa, Dengue virus
SASRA

SEQ ID NO: 1114 - protein, 5 aa, Zika virus
PDSPR

SEQ ID NO: 1115 - protein, 5 aa, Dengue virus
AGKRS

SEQ ID NO: 1116 - protein, 5 aa, Dengue virus
LEQGK

SEQ ID NO: 1117 - protein, 5 aa, Dengue virus
KNSTF

SEQ ID NO: 1118 - protein, 5 aa, Zika virus
SLAGP

SEQ ID NO: 1119 - protein, 5 aa, Zika virus
EECPG

SEQ ID NO: 1120 - protein, 5 aa, Zika virus
EETCG

SEQ ID NO: 1121 - protein, 5 aa, Zika virus
VEETC

SEQ ID NO: 1122 - protein, 5 aa, Usutu virus
SSGRL

SEQ ID NO: 1123 - protein, 5 aa, Usutu virus
LAGPR

SEQ ID NO: 1124 - protein, 5 aa, Usutu virus
RTTTS

SEQ ID NO: 1125 - protein, 5 aa, Usutu virus
TTTSS

SEQ ID NO: 1126 - protein, 1137 aa, Dengue virus
ATGGGCTCCACCTCCCTGTCCGTGACCCTGGTGCTGGTGGGCATCGTGACCCTGTACCTGGGCGTGATGGTGCAGGCCGACTCCGGCTGCGTGGTGTCCTGGAAGAACAAGGAGCTGAAGTGCGGCTCCGGCATCTTCATCACCGACAACGTGCACACCTGGACCGAGCAGTACAAGTTCCAGCCCGAGTCCCCCTCCAAGCTGGCCTCCGCCATCCAGAAGGCCCACGAGGAGGGCATCTGCGGCATCCGCTCCGTGACCCGCCTGGAGAACCTGATGTGGAAGCAGATCACCCCCGAGCTGAACCACATCCTGTCCGAGAACGAGGTGAAGCTGACCATCATGACCGGCGACATCAAGGGCATCATGCAGGCCGGCAAGCGCTCCCTGCGCCCCCAGCCCACCGAGCTGAAGTACTCCTGGAAGACCTGGGGCAAGGCCAAGATGCTGTCCACCGAGTCCCACAACCAGACCTTCCTGATCGACGGCCCCGAGACCGCCGAGTGCCCCAACACCAACCGCGCCTGGAACTCCCTGGAGGTGGAGGACTACGGCTTCGGCGTGTTCACCACCAACATCTGGCTGAAGCTGAAGGAGAAGCAGGACGTGTTCTGCGACTCCAAGCTGATGTCCGCCGCCATCAAGGACAACCGCGCCGTGCACGCCGACATGGGCTACTGGATCGAGTCCGCCCTGAACGACACCTGGAAGATCGAGAAGGCCTCCTTCATCGAGGTGAAGAACTGCCACTGGCCCAAGTCCCACACCCTGTGGTCCAACGGCGTGCTGGAGTCCGAGATGATCATCCCCAAGAACCTGGCCGGCCCCGTGTCCCAGCACAACTACCGCCCCGGCTACCACACCCAGATCACCGGCCCCTGGCACCTGGGCAAGCTGGAGATGGACTTCGACTTCTGCGACGGCACCACCGTGGTGGTGACCGAGGACTGCGGCAACCGCGGCCCCTCCCTGCGCACCACCACCGCCTCCGGCAAGCTGATCACCGAGTGGTGCTGCCGCTCCTGCACCCTGCCCCCCCTGCGCTACCGCGGCGAGGACGGCTGCTGGTACGGCATGGAGATCCGCCCCCTGAAGGAGAAGGAGGAGAACCTGGTGAACTCCCTGGTGACCGCCTAG

SEQ ID NO: 1127 - protein, 378 aa, Dengue virus
MGSTSLSVTLVLVGIVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTA

SEQ ID NO: 1128 - protein, 1137 aa, Dengue virus
ATGGGCAACGGCTCCATCTCCCTGATGTGCCTGGCCCTGGGCGGCGTGCTGATCTTCCTGTCCACCGCCGTGTCCGCCGACGTGGGCTGCTCAGTGGATTTCAGCAAAAAGGAGACCAGATGTGGTACGGGTGTGTTTGTGTACAATGATGTGGAGGCTTGGCGCGATCGATACAAGTACCACCCTGATAGCCCCAGGAGGCTGGCTGCGGCAGTGAAACAAGCGTGGGAGGATGGTATCTGCGGCATTTCCAGTGTCAGTAGGATGGAAAATATAATGTGGCGAAGCGTGGAAGGGGAACTGAATGCAATACTGGAGGAAAACGGGGTCCAACTCACAGTGGTGGTGGGTTCTGTGAAAAATCCGATGTGGAGAGGGCCTCAACGATTGCCTGTCCCGGTAAATGAGCTCCCACACGGTTGGAAGGCATGGGGCAAGTCTTATTTTGTAAGGGCAGCTAAAACAAACAACAGTTTTGTCGTTGATGGGGACACGCTGAAGGAGTGCCCGTTGAAGCACAGAGCCTGGAACAGCTTTTTGGTGGAAGACCATGGATTTGGTGTGTTTCATACGTCAGTATGGCTGAAGGTACGGGAGGATTACAGCCTCGAATGCGATCCCGCTGTTATCGGTACCGCCGTGAAGGGCAAGGAAGCGGTGCACTCCGATTTGGGTTATTGGATTGAAAGCGAGAAAAATGATACTTGGAGGTTGAAACGCGCACATCTCATTGAAATGAAAACTTGCGAGTGGCCTAAATCCCATACTCTCTGGACGGACGGCATTGAGGAAAGCGATCTCATCATTCCCAAATCACTTGCCGGGCCACTTTCTCACCACAACACGAGAGAAGGCTATAGGACTCAGATGAAAGGGCCGTGGCACAGTGAGGAACTCGAAATCCGGTTCGAGGAGTGCCCAGGGACTAAAGTTCATGTTGAGGAGACCTGCGGGACTAGGGGGCCGTCTCTCAGGAGCACGACTGCATCAGGGAGGGTGATCGAGGAATGGTGTTGCCGAGAGTGTACGATGCCTCCGCTGTCTTTCAGGGCAAAAGACGGCTGCTGGTATGGTATGGAGATTCGACCGCGAAAGGAGCCGGAGTCCAACTTGGTCAGGTCAATGGTAACCGCGTAG

SEQ ID NO: 1129 - protein, 378 aa, Zika virus
MGNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTA

SEQ ID NO: 1130 - protein, 1134 aa, Usutu virus
ATGGGCCGCTCCATCGCCCTGGTGATGCTGGCCACCGGCGGCGTGCTGCTGTTCCTGGCCACCAACGTGCACGCCGACTCCGGCTGCGCCATCGACGTGGGCCGCCGCGAGCTGCGCTGCGGCCAGGGCATCTTCATCCACAACGACGTGGAGGCCTGGGTGGACCGCTACAAGTTCATGCCCGGCACCCCCAAGCAGCTGGCCAAGGTGATCGAGCAGGCCCACGCCAAGGGCATCTGCGGCCTGCGCTCCGTGTCCCGCCTGGAGCACGTGATGTGGGAGAACATCCGCGACGAGCTGAACACCCTGCTGCGCGAGAACGCCGTGGACCTGTCCGTGGTGGTGGAGAAGCCCAAGGGCATGTACAAGTCCGCCCCCCAGCGCCTGGCCCTGACCTCCGAGGAGTTCGAGATCGGCTGGAAGGCCTGGGGCAAGTCCCTGGTGTTCGCCCCCGAGCTGGCCAACCACACCTTCGTGGTGGACGGCCCCGAGACCAAGGAGTGCCCCGACGTGAAGCGCGCCTGGAACTCCCTGGAGATCGAGGACTTCGGCTTCGGCATCATGTCCACCCGCGTGTGGCTGAAGGTGCGCGAGCACAACACCACCGACTGCGACTCCTCCATCATCGGCACCGCCGTGAAGGGCGACATCGCCGTGCACTCCGACCTGTCCTACTGGATCGAGTCCCACAAGAACACCACCTGGCGCCTGGAGCGCGCCGTGTTCGGCGAGATCAAGTCCTGCACCTGGCCCGAGACCCACACCCTGTGGTCCGACGGCGTGGTGGAGTCCGACCTGGTGGTGCCCGTGACCCTGGCCGGCCCCAAGTCCAACCACAACCGCCGCGAGGGCTACAAGGTGCAGTCCCAGGGCCCCTGGGACGAGGAGGACATCGTGCTGGACTTCGACTACTGCCCCGGCACCACCGTGACCATCACCGAGGCCTGCGGCAAGCGCGGCCCCTCCATCCGCACCACCACCTCCTCCGGCCGCCTGGTGACCGACTGGTGCTGCCGCTCCTGCACCCTGCCCCCCCTGCGCTACCGCACCAAGAACGGCTGCTGGTACGGCATGGAGATCCGCCCCATGAAGCACGACGAGACCACCCTGGTGAAGTCCTCCGTGTCCGCCTAG

SEQ ID NO: 1131 - protein, 377 aa, Usutu virus
MGRSIALVMLATGGVLLFLATNVHADSGCAIDVGRRELRCGQGIFIHNDVEAWVDRYKFMPGTPKQLAKVIEQAHAKGICGLRSVSRLEHVMWENIRDELNTLLRENAVDLSVVVEKPKGMYKSAPQRLALTSEEFEIGWKAWGKSLVFAPELANHTFVVDGPETKECPDVKRAWNSLEIEDFGFGIMSTRVWLKVREHNTTDCDSSIIGTAVKGDIAVHSDLSYWIESHKNTTWRLERAVFGEIKSCTWPETHTLWSDGVVESDLVVPVTLAGPKSNHNRREGYKVQSQGPWDEEDIVLDFDYCPGTTVTITEACGKRGPSIRTTTSSGRLVTDWCCRSCTLPPLRYRTKNGCWYGMEIRPMKHDETTLVKSSVSA

SEQ ID NO: 1132 - protein, 1860 aa, Dengue virus
ATGGAGACAGACACACTCCTGCTATGGGTACTGCTGCTCTGGGTTCCAGGTTCCACTGGTGACACGCGTTCCGGCTGCGTGGTGTCCTGGAAGAACAAGGAGCTGAAGTGCGGCTCCGGCATCTTCATCACCGACAACGTGCACACCTGGACCGAGCAGTACAAGTTCCAGCCCGAGTCCCCCTCCAAGCTGGCCTCCGCCATCCAGAAGGCCCACGAGGAGGGCATCTGCGGCATCCGCTCCGTGACCCGCCTGGAGAACCTGATGTGGAAGCAGATCACCCCCGAGCTGAACCACATCCTGTCCGAGAACGAGGTGAAGCTGACCATCATGACCGGCGACATCAAGGGCATCATGCAGGCCGGCAAGCGCTCCCTGCGCCCCCAGCCCACCGAGCTGAAGTACTCCTGGAAGACCTGGGGCAAGGCCAAGATGCTGTCCACCGAGTCCCACAACCAGACCTTCCTGATCGACGGCCCCGAGACCGCCGAGTGCCCCAACACCAACCGCGCCTGGAACTCCCTGGAGGTGGAGGACTACGGCTTCGGCGTGTTCACCACCAACATCTGGCTGAAGCTGAAGGAGAAGCAGGACGTGTTCTGCGACTCCAAGCTGATGTCCGCCGCCATCAAGGACAACCGCGCCGTGCACGCCGACATGGGCTACTGGATCGAGTCCGCCCTGAACGACACCTGGAAGATCGAGAAGGCCTCCTTCATCGAGGTGAAGAACTGCCACTGGCCCAAGTCCCACACCCTGTGGTCCAACGGCGTGCTGGAGTCCGAGATGATCATCCCCAAGAACCTGGCCGGCCCCGTGTCCCAGCACAACTACCGCCCCGGCTACCACACCCAGATCACCGGCCCCTGGCACCTGGGCAAGCTGGAGATGGACTTCGACTTCTGCGACGGCACCACCGTGGTGGTGACCGAGGACTGCGGCAACCGCGGCCCCTCCCTGCGCACCACCACCGCCTCCGGCAAGCTGATCACCGAGTGGTGCTGCCGCTCCTGCACCCTGCCCCCCCTGCGCTACCGCGGCGAGGACGGCTGCTGGTACGGCATGGAGATCCGCCCCCTGAAGGAGAAGGAGGAGAACCTGGTGAACTCCCTGGTGACCGCCGGCCACGGCGACTACAAGGACGACGACGACAAGGTCGACGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAATGA

SEQ ID NO: 1133 - protein, 619 aa, Dengue virus
METDTLLLWVLLLWVPGSTGDTRSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTESHNQTFLIDGPETAECPNTNRAWNSLEVEDYGFGVFTTNIWLKLKEKQDVFCDSKLMSAAIKDNRAVHADMGYWIESALNDTWKIEKASFIEVKNCHWPKSHTLWSNGVLESEMIIPKNLAGPVSQHNYRPGYHTQITGPWHLGKLEMDFDFCDGTTVVVTEDCGNRGPSLRTTTASGKLITEWCCRSCTLPPLRYRGEDGCWYGMEIRPLKEKEENLVNSLVTAGHGDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1134 - protein, 1854 aa, Zika virus
ATGGAGACAGACACACTCCTGCTATGGGTACTGCTGCTCTGGGTTCCAGGTTCCACTGGTGACACGCGTGGCTGCTCCGTGGACTTCTCCAAGAAGGAGACCCGCTGCGGCACCGGCGTGTTCGTGTACAACGACGTGGAGGCCTGGCGCGACCGCTACAAGTACCACCCCGACTCCCCCCGCCGCCTGGCCGCCGCCGTGAAGCAGGCCTGGGAGGACGGCATCTGCGGCATCTCCTCCGTGTCCCGCATGGAGAACATCATGTGGCGCTCCGTGGAGGGCGAGCTGAACGCCATCCTGGAGGAGAACGGCGTGCAGCTGACCGTGGTGGTGGGCTCCGTGAAGAACCCCATGTGGCGCGGCCCCCAGCGCCTGCCCGTGCCCGTGAACGAGCTGCCCCACGGCTGGAAGGCCTGGGGCAAGTCCCACTTCGTGCGCGCCGCCAAGACCAACAACTCCTTCGTGGTGGACGGCGACACCCTGAAGGAGTGCCCCCTGAAGCACCGCGCCTGGAACTCCTTCCTGGTGGAGGACCACGGCTTCGGCGTGTTCCACACCTCCGTGTGGCTGAAGGTGCGCGAGGACTACTCCCTGGAGTGCGACCCCGCCGTGATCGGCACCGCCGTGAAGGGCAAGGAGGCCGTGCACTCCGACCTGGGCTACTGGATCGAGTCCGAGAAGAACGACACCTGGCGCCTGAAGCGCGCCCACCTGATCGAGATGAAGACCTGCGAGTGGCCCAAGTCCCACACCCTGTGGACCGACGGCATCGAGGAGTCCGACCTGATCATCCCCAAGTCCCTGGCCGGCCCCCTGTCCCACCACAACACCCGCGAGGGCTACCGCACCCAGATGAAGGGCCCCTGGCACTCCGAGGAGCTGGAGATCCGCTTCGAGGAGTGCCCCGGCACCAAGGTGCACGTGGAGGAGACCTGCGGCACCCGCGGCCCCTCCCTGCGCTCCACCACCGCCTCCGGCCGCGTGATCGAGGAGTGGTGCTGCCGCGAGTGCACCATGCCCCCCCTGTCCTTCCGCGCCAAGGACGGCTGCTGGTACGGCATGGAGATCCGCCCCCGCAAGGAGCCCGAGTCCAACCTGGTGCGCTCCATGGTGACCGCCGGCTCCGACTACAAGGACGACGACGACAAGGTCGACGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAATGA

SEQ ID NO: 1135 - protein, 617 aa, Zika virus
METDTLLLWVLLLWVPGSTGDTRGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSHFVRAAKTNNSFVVDGDTLKECPLKHRAWNSFLVEDHGFGVFHTSVWLKVREDYSLECDPAVIGTAVKGKEAVHSDLGYWIESEKNDTWRLKRAHLIEMKTCEWPKSHTLWTDGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSMVTAGSDYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1136 - protein, 1854 aa, Usutu virus
ATGGAGACAGACACACTCCTGCTATGGGTACTGCTGCTCTGGGTTCCAGGTTCCACTGGTGACACGCGTGACTCCGGCTGCGCCATCGACGTGGGCCGCCGCGAGCTGCGCTGCGGCCAGGGCATCTTCATCCACAACGACGTGGAGGCCTGGGTGGACCGCTACAAGTTCATGCCCGGCACCCCCAAGCAGCTGGCCAAGGTGATCGAGCAGGCCCACGCCAAGGGCATCTGCGGCCTGCGCTCCGTGTCCCGCCTGGAGCACGTGATGTGGGAGAACATCCGCGACGAGCTGAACACCCTGCTGCGCGAGAACGCCGTGGACCTGTCCGTGGTGGTGGAGAAGCCCAAGGGCATGTACAAGTCCGCCCCCCAGCGCCTGGCCCTGACCTCCGAGGAGTTCGAGATCGGCTGGAAGGCCTGGGGCAAGTCCCTGGTGTTCGCCCCCGAGCTGGCCAACCACACCTTCGTGGTGGACGGCCCCGAGACCAAGGAGTGCCCCGACGTGAAGCGCGCCTGGAACTCCCTGGAGATCGAGGACTTCGGCTTCGGCATCATGTCCACCCGCGTGTGGCTGAAGGTGCGCGAGCACAACACCACCGACTGCGACTCCTCCATCATCGGCACCGCCGTGAAGGGCGACATCGCCGTGCACTCCGACCTGTCCTACTGGATCGAGTCCCACAAGAACACCACCTGGCGCCTGGAGCGCGCCGTGTTCGGCGAGATCAAGTCCTGCACCTGGCCCGAGACCCACACCCTGTGGTCCGACGGCGTGGTGGAGTCCGACCTGGTGGTGCCCGTGACCCTGGCCGGCCCCCGCTCCAACCACAACCGCCGCGAGGGCTACAAGGTGCAGTCCCAGGGCCCCTGGGACGAGGAGGACATCGTGCTGGACTTCGACTACTGCCCCGGCACCACCGTGACCATCACCGAGGCCTGCGGCAAGCGCGGCCCCTCCATCCGCACCACCACCTCCTCCGGCCGCCTGGTGACCGACTGGTGCTGCCGCTCCTGCACCCTGCCCCCCCTGCGCTACCGCACCAAGAACGGCTGCTGGTACGGCATGGAGATCCGCCCCATGAAGCACGACGAGACCACCCTGGTGAAGTCCTCCGTGTCCGCCGACTACAAGGACGACGACGACAAGGTCGACGAGCCCAAATCTTGTGACAAAACTCACACATGCCCACCGTGCCCAGCACCTGAACTCCTGGGGGGACCGTCAGTCTTCCTCTTCCCCCCAAAACCCAAGGACACCCTCATGATCTCCCGGACCCCTGAGGTCACATGCGTGGTGGTGGACGTGAGCCACGAAGACCCTGAGGTCAAGTTCAACTGGTACGTGGACGGCGTGGAGGTGCATAATGCCAAGACAAAGCCGCGGGAGGAGCAGTACAACAGCACGTACCGTGTGGTCAGCGTCCTCACCGTCCTGCACCAGGACTGGCTGAATGGCAAGGAGTACAAGTGCAAGGTCTCCAACAAAGCCCTCCCAGCCCCCATCGAGAAAACCATCTCCAAAGCCAAAGGGCAGCCCCGAGAACCACAGGTGTACACCCTGCCCCCATCCCGGGAGGAGATGACCAAGAACCAGGTCAGCCTGACCTGCCTGGTCAAAGGCTTCTATCCCAGCGACATCGCCGTGGAGTGGGAGAGCAATGGGCAGCCGGAGAACAACTACAAGACCACGCCTCCCGTGCTGGACTCCGACGGCTCCTTCTTCCTCTATAGCAAGCTCACCGTGGACAAGAGCAGGTGGCAGCAGGGGAACGTCTTCTCATGCTCCGTGATGCATGAGGCTCTGCACAACCACTACACGCAGAAGAGCCTCTCCCTGTCTCCGGGTAAATGA

SEQ ID NO: 1137 - protein, 617 aa, Usutu virus
METDTLLLWVLLLWVPGSTGDTRDSGCAIDVGRRELRCGQGIFIHNDVEAWVDRYKFMPGTPKQLAKVIEQAHAKGICGLRSVSRLEHVMWENIRDELNTLLRENAVDLSVVVEKPKGMYKSAPQRLALTSEEFEIGWKAWGKSLVFAPELANHTFVVDGPETKECPDVKRAWNSLEIEDFGFGIMSTRVWLKVREHNTTDCDSSIIGTAVKGDIAVHSDLSYWIESHKNTTWRLERAVFGEIKSCTWPETHTLWSDGVVESDLVVPVTLAGPRSNHNRREGYKVQSQGPWDEEDIVLDFDYCPGTTVTITEACGKRGPSIRTTTSSGRLVTDWCCRSCTLPPLRYRTKNGCWYGMEIRPMKHDETTLVKSSVSADYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1138 - protein, 22 aa, Yellow fever virus
CDGRGKSTRSTTDSGKVIPEWC

SEQ ID NO: 1139 - protein, 22 aa, Dengue virus
CGNRGPSLRTTTVTGKIIHEWC

SEQ ID NO: 1140 - protein, 22 aa, Dengue virus
CGNRGPSLRTTTASGKLITEWC

SEQ ID NO: 1141 - protein, 22 aa, Dengue virus
CGTRGPSLRTTTVSGKLIHEWC

SEQ ID NO: 1142 - protein, 22 aa, Dengue virus
CDHRGPSLRTTTASGKLVTQWC

SEQ ID NO: 1143 - protein, 22 aa, Zika virus
CGTRGPSLRSTTASGRVIEEWC

SEQ ID NO: 1144 - protein, 22 aa, West Nile virus
CEHRGPAARTTTESGKLITDWC

SEQ ID NO: 1145 - protein, 22 aa, Japanese encephalitis virus
CSKRGPSVRTTTDSGKLITDWC

SEQ ID NO: 1146 - protein, 22 aa, Tick-borne meningoencephalitis virus
CDKRGASVRSTTESGKVIPEWC

SEQ ID NO: 1147 - protein, 22 aa, Saint Louis encephalitis virus
CGNRGASLRTTTASGKLVTDWC

SEQ ID NO: 1148 - protein, 22 aa, Usutu virus
CGKRGPSIRTTTSSGRLVTDWC

SEQ ID NO: 1149 - protein, 22 aa, Artificial sequence
  synthetic
CGTRGPSLRMTTVMGRVIEEWC

SEQ ID NO: 1150 - DNA, 810 bp, Artificial sequence
  synthetic
atgtgtggcacgcgagggccgagtcttagatcaaccaccgcatctggccgggtcatagaggaatggtgcgtcgacggtggtggcggttcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 1151 - protein, 269 aa, Artificial sequence
  synthetic
MCGTRGPSLRSTTASGRVIEEWCVDGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 1152 - DNA, 810 bp, Artificial sequence
  synthetic
atgtgcgggacacgcgggccatccttgaggatgactacggtcatgggacgagttatagaagaatggtgtgtcgacggtggtggcggttcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 1153 - protein, 269 aa, Artificial sequence
  synthetic
MCGTRGPSLRMTTVMGRVIEEWCVDGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 1154 - DNA, 810 bp, Artificial sequence
  synthetic
atgtgtgatggtcgcggaaagagcactagaagcaccaccgactctgggaaagttatacccgaatggtgcgtcgacggtggtggcggttcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 1155 - protein, 269 aa, Artificial sequence
  synthetic
MCDGRGKSTRSTTDSGKVIPEWCVDGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 1156 - DNA, 810 bp, Artificial sequence
  synthetic
atgtgcgagcataggggacccgctgcgcggacaacaaccgagagtgggaaactcattacagattggtgtgtcgacggtggtggcggttcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 1157 - protein, 269 aa, Artificial sequence
  synthetic
MCEHRGPAARTTTESGKLITDWCVDGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 1158 - DNA, 810 bp, Artificial sequence
  synthetic
atgtgtggaaatcgcggtccgagcttgcgaaccactacggcttccgggaagctcatcaccgaatggtgcgtcgacggtggtggcggttcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 1159 - protein, 269 aa, Artificial sequence
  synthetic
MCGNRGPSLRTTTASGKLITEWCVDGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 1160 - DNA, 810 bp, Artificial sequence
  synthetic
atgtgcggtaaaaggggaccttctatcaggacaactaccagttcaggtcgcctggtcactgattggtgtgtcgacggtggtggcggttcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtag

SEQ ID NO: 1161 - protein, 5 aa, Usutu virus
ETEAT

SEQ ID NO: 1162 - protein, 5 aa, Usutu virus
PTTGE

SEQ ID NO: 1163 - protein, 5 aa, Usutu virus
KSGVT

SEQ ID NO: 1164 - protein, 5 aa, Usutu virus
GKGSI

SEQ ID NO: 1165 - protein, 5 aa, Usutu virus
GSTSS

SEQ ID NO: 1166 - protein, 5 aa, Usutu virus
STSSD

SEQ ID NO: 1167 - protein, 5 aa, Usutu virus
QLGAS

SEQ ID NO: 1168 - protein, 5 aa, Usutu virus
QLGAS

SEQ ID NO: 1169 - protein, 5 aa, Usutu virus
GASQA

SEQ ID NO: 1170 - protein, 5 aa, Usutu virus
ASQAG

SEQ ID NO: 1171 - protein, 5 aa, Usutu virus
SQAGR

SEQ ID NO: 1172 - protein, 5 aa, Usutu virus
SPASS

SEQ ID NO: 1173 - protein, 5 aa, Usutu virus
SPASS

SEQ ID NO: 1174 - protein, 5 aa, Usutu virus
LTSGH

SEQ ID NO: 1175 - protein, 5 aa, Usutu virus
LKGTT

SEQ ID NO: 1176 - protein, 5 aa, Usutu virus
VASSE

SEQ ID NO: 1177 - protein, 5 aa, Usutu virus
ASSEA

SEQ ID NO: 1178 - protein, 5 aa, Usutu virus
GDKQI

SEQ ID NO: 1179 - protein, 5 aa, Usutu virus
AGSSI

SEQ ID NO: 1180 - protein, 5 aa, Usutu virus
STKAS

SEQ ID NO: 1181 - protein, 5 aa, Usutu virus
AKDKP

SEQ ID NO: 1182 - protein, 5 aa, Usutu virus
RAEDT

SEQ ID NO: 1183 - protein, 5 aa, Usutu virus
SGVTD

SEQ ID NO: 1184 - protein, 5 aa, Usutu virus
GSIDT

SEQ ID NO: 1185 - protein, 5 aa, Usutu virus
GSTSS

SEQ ID NO: 1186 - protein, 5 aa, Usutu virus
STSSD

SEQ ID NO: 1187 - protein, 5 aa, Usutu virus
SSQLG

SEQ ID NO: 1188 - protein, 5 aa, Usutu virus
LGASQ

SEQ ID NO: 1189 - protein, 5 aa, Usutu virus
TPNSP

SEQ ID NO: 1190 - protein, 5 aa, Usutu virus
WTSPA

SEQ ID NO: 1191 - protein, 5 aa, Usutu virus
SPASS

SEQ ID NO: 1192 - protein, 5 aa, Usutu virus
SPASS

SEQ ID NO: 1193 - protein, 5 aa, Usutu virus
ALGSQ

SEQ ID NO: 1194 - protein, 5 aa, Usutu virus
QEGAL

SEQ ID NO: 1195 - protein, 5 aa, Usutu virus
TGSDG

SEQ ID NO: 1196 - protein, 5 aa, Usutu virus
SSEAN

SEQ ID NO: 1197 - protein, 5 aa, Usutu virus
METEA

SEQ ID NO: 1198 - protein, 5 aa, Usutu virus
STVSN

SEQ ID NO: 1199 - protein, 5 aa, Usutu virus
KSGVT

SEQ ID NO: 1200 - protein, 5 aa, Usutu virus
STSSD

SEQ ID NO: 1201 - protein, 5 aa, Usutu virus
ASQAG

SEQ ID NO: 1202 - protein, 5 aa, Usutu virus
SPASS

SEQ ID NO: 1203 - protein, 5 aa, Usutu virus
QEGAL

SEQ ID NO: 1204 - protein, 5 aa, Usutu virus
QEGAL

SEQ ID NO: 1205 - protein, 5 aa, Usutu virus
SGSVK

SEQ ID NO: 1206 - protein, 5 aa, Usutu virus
LSDLT

SEQ ID NO: 1207 - protein, 5 aa, Usutu virus
SSEAN

SEQ ID NO: 1208 - protein, 5 aa, Usutu virus
GAQRL

SEQ ID NO: 1209 - protein, 5 aa, Usutu virus
ALGDT

SEQ ID NO: 1210 - DNA, 1572 bp, Artificial sequence
  synthetic
atggagacagacacactcctgctatgggtactgctgctctgggttccaggttccactggtgacacgcgtttcaactgcctgggcatgtccaaccgcgacttcctggagggcgtgtccggcgccacctgggtggacgtggtgctggagggcgactcctgcatcaccatcatggccaaggacaagcccaccatcgacatcaagatgatggagaccgaggccaccaacctggccgaggtgcgctcctactgctacctggccaccgtgtccgacgtgtccaccgtgtccaactgccccaccaccggcgaggcccacaaccccaagcgcgccgaggacacctacgtgtgcaagtccggcgtgaccgaccgcggctggggcaacggctgcggcctgttcggcaagggctccatcgacacctgcgccaacttcacctgctccctgaaggccatgggccgcatgatccagcccgagaacgtgaagtacgaggtgggcatcttcatccacggctccacctcctccgacacccacggcaactactcctcccagctgggcgcctcccaggccggccgcttcaccatcacccccaactcccccgccatcaccgtgaagatgggcgactacggcgagatctccgtggagtgcgagccccgcaacggcctgaacaccgaggcctactacatcatgtccgtgggcaccaagcacttcctggtgcaccgcgagtggttcaacgacctggccctgccctggacctcccccgcctcctccaactggcgcaaccgcgagatcctgctggagttcgaggagccccacgccaccaagcagtccgtggtggccctgggctcccaggagggcgccctgcaccaggccctggccggcgccgtgcccgtgtccttctccggctccgtgaagctgacctccggccacctgaagtgccgcgtgaagatggagaagctgaccctgaagggcaccacctacggcatgtgcaccgagaagttctccttcgccaagaaccccgccgacaccggccacggcaccgtggtgctggagctgcagtacaccggctccgacggcccctgcaagatccccatctccatcgtggcctccctgtccgacctgacccccatcggccgcatggtgaccgccaacccctacgtggcctcctccgaggccaacgccaaggtgctggtggagatggagccccccttcggcgactcctacatcgtggtgggccgcggcgacaagcagatcaaccaccactggcacaaggccggctcctccatcggcaaggccttcatcaccaccatcaagggcgcccagcgcctggccgccctgggcgacaccgcctgggacttcggctccgtgggcggcatcttcaactccgtgggcaaggccgtgcaccaggtgttcggcggcgccttccgcaccctgttcggcggcatgtcctggatcacccagggcctgatgggcgccctgctgctgtggatgggcgtgaacgcccgcgaccgctccatcgccctggtgatgctggccaccggcggcgtgctgctgttcctggccaccaacgtgcacgcctag

SEQ ID NO: 1211 - protein, 523 aa, Artificial sequence
  synthetic
METDTLLLWVLLLWVPGSTGDTRFNCLGMSNRDFLEGVSGATWVDVVLEGDSCITIMAKDKPTIDIKMMETEATNLAEVRSYCYLATVSDVSTVSNCPTTGEAHNPKRAEDTYVCKSGVTDRGWGNGCGLFGKGSIDTCANFTCSLKAMGRMIQPENVKYEVGIFIHGSTSSDTHGNYSSQLGASQAGRFTITPNSPAITVKMGDYGEISVECEPRNGLNTEAYYIMSVGTKHFLVHREWFNDLALPWTSPASSNWRNREILLEFEEPHATKQSVVALGSQEGALHQALAGAVPVSFSGSVKLTSGHLKCRVKMEKLTLKGTTYGMCTEKFSFAKNPADTGHGTVVLELQYTGSDGPCKIPISIVASLSDLTPIGRMVTANPYVASSEANAKVLVEMEPPFGDSYIVVGRGDKQINHHWHKAGSSIGKAFITTIKGAQRLAALGDTAWDFGSVGGIFNSVGKAVHQVFGGAFRTLFGGMSWITQGLMGALLLWMGVNARDRSIALVMLATGGVLLFLATNVHA

SEQ ID NO: 1212 - DNA, 2298 bp, Artificial sequence
  synthetic
atggagacagacacactcctgctatgggtactgctgctctgggttccaggttccactggtgacacgcgtttcaactgcctgggcatgtccaaccgcgacttcctggagggcgtgtccggcgccacctgggtggacgtggtgctggagggcgactcctgcatcaccatcatggccaaggacaagcccaccatcgacatcaagatgatggagaccgaggccaccaacctggccgaggtgcgctcctactgctacctggccaccgtgtccgacgtgtccaccgtgtccaactgccccaccaccggcgaggcccacaaccccaagcgcgccgaggacacctacgtgtgcaagtccggcgtgaccgaccgcggctggggcaacggctgcggcctgttcggcaagggctccatcgacacctgcgccaacttcacctgctccctgaaggccatgggccgcatgatccagcccgagaacgtgaagtacgaggtgggcatcttcatccacggctccacctcctccgacacccacggcaactactcctcccagctgggcgcctcccaggccggccgcttcaccatcacccccaactcccccgccatcaccgtgaagatgggcgactacggcgagatctccgtggagtgcgagccccgcaacggcctgaacaccgaggcctactacatcatgtccgtgggcaccaagcacttcctggtgcaccgcgagtggttcaacgacctggccctgccctggacctcccccgcctcctccaactggcgcaaccgcgagatcctgctggagttcgaggagccccacgccaccaagcagtccgtggtggccctgggctcccaggagggcgccctgcaccaggccctggccggcgccgtgcccgtgtccttctccggctccgtgaagctgacctccggccacctgaagtgccgcgtgaagatggagaagctgaccctgaagggcaccacctacggcatgtgcaccgagaagttctccttcgccaagaaccccgccgacaccggccacggcaccgtggtgctggagctgcagtacaccggctccgacggcccctgcaagatccccatctccatcgtggcctccctgtccgacctgacccccatcggccgcatggtgaccgccaacccctacgtggcctcctccgaggccaacgccaaggtgctggtggagatggagccccccttcggcgactcctacatcgtggtgggccgcggcgacaagcagatcaaccaccactggcacaaggccggctcctccatcggcaaggccttcatcaccaccatcaagggcgcccagcgcctggccgccctgggcgacaccgcctgggacttcggctccgtgggcggcatcttcaactccgtgggcaaggccgtgcaccaggtgttcggcggcgccttccgcaccctgttcggcggcatgtcctggatcacccagggcctgatgggcgccctgctgctgtggatgggcgtgaacgcccgcgaccgctccatcgccctggtgatgctggccaccggcggcgtgctgctgttcctggccaccaacgtgcacgccgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1213 - protein, 765 aa, Artificial sequence
  synthetic
METDTLLLWVLLLWVPGSTGDTRFNCLGMSNRDFLEGVSGATWVDVVLEGDSCITIMAKDKPTIDIKMMETEATNLAEVRSYCYLATVSDVSTVSNCPTTGEAHNPKRAEDTYVCKSGVTDRGWGNGCGLFGKGSIDTCANFTCSLKAMGRMIQPENVKYEVGIFIHGSTSSDTHGNYSSQLGASQAGRFTITPNSPAITVKMGDYGEISVECEPRNGLNTEAYYIMSVGTKHFLVHREWFNDLALPWTSPASSNWRNREILLEFEEPHATKQSVVALGSQEGALHQALAGAVPVSFSGSVKLTSGHLKCRVKMEKLTLKGTTYGMCTEKFSFAKNPADTGHGTVVLELQYTGSDGPCKIPISIVASLSDLTPIGRMVTANPYVASSEANAKVLVEMEPPFGDSYIVVGRGDKQINHHWHKAGSSIGKAFITTIKGAQRLAALGDTAWDFGSVGGIFNSVGKAVHQVFGGAFRTLFGGMSWITQGLMGALLLWMGVNARDRSIALVMLATGGVLLFLATNVHADYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1214 - DNA, 1572 bp, Artificial sequence
  synthetic
atggagacagacacactcctgctatgggtactgctgctctgggttccaggttccactggtgacacgcgtttcaactgcctgggcatgtccaaccgcgacttcctggagggcgtgtccggcgccacctgggtggacgtggtgctggagggcgactcctgcatcaccatcatggccaaggacaagcccaccatcgacatcaagatgatgctgtccgacgccaccaacctggccgaggtgcgctcctactgctacctggccaccgtgtccgacgtgtccaccgtgtccaactgccccaccaccggcgaggcccacaaccccaagcgcgccgaggacacctacgtgtgcaagtccggcgtgaccgaccgcggctggggcaacggctgcggcctgttcggcaagggctccatcgacacctgcgccaacttcacctgctccctgaaggccatgggccgcatgatccagcccgagaacgtgaagtacgaggtgggcatcttcatccacggctcctccacctccgagacccacggcaactactccaccaaggtgggcgcctcccaggccggccgcttcaccatcacccccaactcccccgccatcaccgtgaagatgggcgactacggcgagatctccgtggagtgcgagccccgcaacggcctgaacaccgaggcctactacatcatgtccgtgggcaccaagcacttcctggtgcaccgcgagtggttcaacgacctggccctgccctggacctcccccctgacctccaactggcgcaaccgcgagatcctgctggagttcgaggagccccacgccaccaagcagtccgtggtggccctgggctcccaggagggcgccctgcaccaggccctggccggcgccgtgcccgtgtccttcaccggcaccgagaagctgacctccggccacctgaagtgccgcgtgaagatggagaagctgaccctgaagggcaccacctacggcatgtgcaccgagaagttctccttcgccaagaaccccgccgacaccggccacggcaccgtggtgctggagctgcagtacaccggctccgacggcccctgcaagatccccatctccatcgtggcctccctgtccgacctgacccccatcggccgcatggtgaccgccaacccctacgtgatctccaccgacgccaacgccaaggtgctggtggagatggagccccccttcggcgactcctacatcgtggtgggccgcggcgacaagcagatcaaccaccactggcacaaggccggctcctccatcggcaaggccttcatcaccaccatcaagggcgcccagcgcctggccgccctgggcgacaccgcctgggacttcggctccgtgggcggcatcttcaactccgtgggcaaggccgtgcaccaggtgttcggcggcgccttccgcaccctgttcggcggcatgtcctggatcacccagggcctgatgggcgccctgctgctgtggatgggcgtgaacgcccgcgaccgctccatcgccctggtgatgctggccaccggcggcgtgctgctgttcctggccaccaacgtgcacgcctag

SEQ ID NO: 1215 - protein, 523 aa, Artificial sequence
  synthetic
METDTLLLWVLLLWVPGSTGDTRFNCLGMSNRDFLEGVSGATWVDVVLEGDSCITIMAKDKPTIDIKMMLSDATNLAEVRSYCYLATVSDVSTVSNCPTTGEAHNPKRAEDTYVCKSGVTDRGWGNGCGLFGKGSIDTCANFTCSLKAMGRMIQPENVKYEVGIFIHGSSTSETHGNYSTKVGASQAGRFTITPNSPAITVKMGDYGEISVECEPRNGLNTEAYYIMSVGTKHFLVHREWFNDLALPWTSPLTSNWRNREILLEFEEPHATKQSVVALGSQEGALHQALAGAVPVSFTGTEKLTSGHLKCRVKMEKLTLKGTTYGMCTEKFSFAKNPADTGHGTVVLELQYTGSDGPCKIPISIVASLSDLTPIGRMVTANPYVISTDANAKVLVEMEPPFGDSYIVVGRGDKQINHHWHKAGSSIGKAFITTIKGAQRLAALGDTAWDFGSVGGIFNSVGKAVHQVFGGAFRTLFGGMSWITQGLMGALLLWMGVNARDRSIALVMLATGGVLLFLATNVHA

SEQ ID NO: 1216 - DNA, 2298 bp, Artificial sequence
  synthetic
atggagacagacacactcctgctatgggtactgctgctctgggttccaggttccactggtgacacgcgtttcaactgcctgggcatgtccaaccgcgacttcctggagggcgtgtccggcgccacctgggtggacgtggtgctggagggcgactcctgcatcaccatcatggccaaggacaagcccaccatcgacatcaagatgatgctgtccgacgccaccaacctggccgaggtgcgctcctactgctacctggccaccgtgtccgacgtgtccaccgtgtccaactgccccaccaccggcgaggcccacaaccccaagcgcgccgaggacacctacgtgtgcaagtccggcgtgaccgaccgcggctggggcaacggctgcggcctgttcggcaagggctccatcgacacctgcgccaacttcacctgctccctgaaggccatgggccgcatgatccagcccgagaacgtgaagtacgaggtgggcatcttcatccacggctcctccacctccgagacccacggcaactactccaccaaggtgggcgcctcccaggccggccgcttcaccatcacccccaactcccccgccatcaccgtgaagatgggcgactacggcgagatctccgtggagtgcgagccccgcaacggcctgaacaccgaggcctactacatcatgtccgtgggcaccaagcacttcctggtgcaccgcgagtggttcaacgacctggccctgccctggacctcccccctgacctccaactggcgcaaccgcgagatcctgctggagttcgaggagccccacgccaccaagcagtccgtggtggccctgggctcccaggagggcgccctgcaccaggccctggccggcgccgtgcccgtgtccttcaccggcaccgagaagctgacctccggccacctgaagtgccgcgtgaagatggagaagctgaccctgaagggcaccacctacggcatgtgcaccgagaagttctccttcgccaagaaccccgccgacaccggccacggcaccgtggtgctggagctgcagtacaccggctccgacggcccctgcaagatccccatctccatcgtggcctccctgtccgacctgacccccatcggccgcatggtgaccgccaacccctacgtgatctccaccgacgccaacgccaaggtgctggtggagatggagccccccttcggcgactcctacatcgtggtgggccgcggcgacaagcagatcaaccaccactggcacaaggccggctcctccatcggcaaggccttcatcaccaccatcaagggcgcccagcgcctggccgccctgggcgacaccgcctgggacttcggctccgtgggcggcatcttcaactccgtgggcaaggccgtgcaccaggtgttcggcggcgccttccgcaccctgttcggcggcatgtcctggatcacccagggcctgatgggcgccctgctgctgtggatgggcgtgaacgcccgcgaccgctccatcgccctggtgatgctggccaccggcggcgtgctgctgttcctggccaccaacgtgcacgccgactacaaggacgacgacgacaaggtcgacgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 1217 - protein, 765 aa, Artificial sequence
  synthetic
METDTLLLWVLLLWVPGSTGDTRFNCLGMSNRDFLEGVSGATWVDVVLEGDSCITIMAKDKPTIDIKMMLSDATNLAEVRSYCYLATVSDVSTVSNCPTTGEAHNPKRAEDTYVCKSGVTDRGWGNGCGLFGKGSIDTCANFTCSLKAMGRMIQPENVKYEVGIFIHGSSTSETHGNYSTKVGASQAGRFTITPNSPAITVKMGDYGEISVECEPRNGLNTEAYYIMSVGTKHFLVHREWFNDLALPWTSPLTSNWRNREILLEFEEPHATKQSVVALGSQEGALHQALAGAVPVSFTGTEKLTSGHLKCRVKMEKLTLKGTTYGMCTEKFSFAKNPADTGHGTVVLELQYTGSDGPCKIPISIVASLSDLTPIGRMVTANPYVISTDANAKVLVEMEPPFGDSYIVVGRGDKQINHHWHKAGSSIGKAFITTIKGAQRLAALGDTAWDFGSVGGIFNSVGKAVHQVFGGAFRTLFGGMSWITQGLMGALLLWMGVNARDRSIALVMLATGGVLLFLATNVHADYKDDDDKVDEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1218 - protein, 5 aa, Usutu virus
PTTGE

SEQ ID NO: 1219 - protein, 5 aa, Usutu virus
NPKRA

SEQ ID NO: 1220 - protein, 5 aa, Usutu virus
SSDTH

SEQ ID NO: 1221 - protein, 5 aa, Usutu virus
HGNYS

SEQ ID NO: 1222 - protein, 5 aa, Usutu virus
PNSPA

SEQ ID NO: 1223 - protein, 5 aa, Usutu virus
PRNGL

SEQ ID NO: 1224 - protein, 5 aa, Usutu virus
TSPAS

SEQ ID NO: 1225 - protein, 5 aa, Usutu virus
PASSN

SEQ ID NO: 1226 - protein, 5 aa, Usutu virus
PHATK

SEQ ID NO: 1227 - protein, 5 aa, Usutu virus
FAKNP

SEQ ID NO: 1228 - protein, 5 aa, Usutu virus
TGSDG

SEQ ID NO: 1229 - protein, 5 aa, Usutu virus
ASSEA

SEQ ID NO: 1230 - protein, 5 aa, Usutu virus
MPETP

SEQ ID NO: 1231 - protein, 5 aa, Usutu virus
PKGMY

SEQ ID NO: 1232 - protein, 5 aa, Usutu virus
PETKE

SEQ ID NO: 1233 - protein, 5 aa, Usutu virus
HNTTD

SEQ ID NO: 1234 - protein, 5 aa, Usutu virus
PKSNH

SEQ ID NO: 1235 - protein, 5 aa, Usutu virus
QGPWD

SEQ ID NO: 1236 - protein, 5 aa, Usutu virus
SIRTT

SEQ ID NO: 1237 - protein, 5 aa, Usutu virus
RTTTS

SEQ ID NO: 1238 - protein, 5 aa, Artifical sequence
STTAS

SEQ ID NO: 1239 - protein, 15 aa, Artifical sequence
GPSLRSTTASGRVIE

SEQ ID NO: 1240 - protein, 15 aa, Artifical sequence
GPSLRMTMVSGRVIE

SEQ ID NO: 1241 - protein, 86 aa, Artifical sequence
SAVGEHEKVINNQKEKEDFHSYLPIIDPILSKSKSYKNEVTPSSTTASVARKRKSDGMEDANVRVAITEHTEVREIKRIHFSPSEP

SEQ ID NO: 1242 - protein, 86 aa, Artifical sequence
SAVGEHEKVINNQKEKEDFHSYLPIIDPILSKSKSYKNEVTPSMTMVSVARKRKSDGMEDANVRVAITEHTEVREIKRIHFSPSEP

SEQ ID NO: 1243 - protein, 86 aa, Artifical sequence
SAVGEHEKVINNQKEKEDFHSYLPIIDPILSKSKSYKNEVTPSSTTDSVARKRKSDGMEDANVRVAITEHTEVREIKRIHFSPSEP

SEQ ID NO: 1244 - protein, 22 aa, Artificial sequence
  synthetic
  misc_feature (2)..(3): Xaa can be any naturally occurring amino acid
  misc_feature (6)..(8): Xaa can be any naturally occurring amino acid
  misc_feature (10)..(10): Xaa can be any naturally occurring amino acid
  misc_feature (13)..(14): Xaa can be any naturally occurring amino acid
  misc_feature (16)..(20): Xaa can be any naturally occurring amino acid
CXXRGXXXRXTTXXGXXXXXWC

SEQ ID NO: 1245 - protein, 5 aa, Dengue virus
QGKRT

SEQ ID NO: 1246 - protein, 5 aa, West Nile virus
DKPTI

SEQ ID NO: 1247 - protein, 5 aa, West Nile virus
TTVES

SEQ ID NO: 1248 - protein, 5 aa, West Nile virus
EPRSG

SEQ ID NO: 1249 - protein, 5 aa, West Nile virus
GSQEG

SEQ ID NO: 1250 - protein, 5 aa, West Nile virus
KGTTY

SEQ ID NO: 1251 - protein, 5 aa, West Nile virus
PADTG

SEQ ID NO: 1252 - protein, 5 aa, West Nile virus
TGTDG

SEQ ID NO: 1253 - protein, 5 aa, West Nile virus
RGEQQ

SEQ ID NO: 1254 - protein, 5 aa, Zika virus
MSGGT

SEQ ID NO: 1255 - protein, 5 aa, Zika virus
DKPTV

SEQ ID NO: 1256 - protein, 5 aa, Dengue virus
RGWGN

SEQ ID NO: 1257 - protein, 5 aa, Artificial sequence
  synthetic
KGLRS

SEQ ID NO: 1258 - protein, 6 aa, Artificial sequence
  synthetic
DRGWGN

SEQ ID NO: 1259 - protein, 7 aa, Artificial sequence
  synthetic
DRGWGNG

SEQ ID NO: 1260 - protein, 5 aa, Artificial sequence
  synthetic
GGGLV

SEQ ID NO: 1261 - protein, 5 aa, Artificial sequence
  synthetic
APPSE

SEQ ID NO: 1262 - protein, 5 aa, Artificial sequence
  synthetic
DSRCP

SEQ ID NO: 1263 - protein, 5 aa, Artificial sequence
  synthetic
ITPNS

SEQ ID NO: 1264 - protein, 5 aa, Artificial sequence
  synthetic
ITPQA

SEQ ID NO: 1265 - protein, 5 aa, Artificial sequence
  synthetic
PPSEI

SEQ ID NO: 1266 - protein, 5 aa, Artificial sequence
  synthetic
PQAPP

SEQ ID NO: 1267 - protein, 5 aa, Artificial sequence
  synthetic
QAPPS

SEQ ID NO: 1268 - protein, 5 aa, Artificial sequence
  synthetic
QAPTS

SEQ ID NO: 1269 - protein, 5 aa, Artificial sequence
  synthetic
TTEHG

SEQ ID NO: 1270 - protein, 5 aa, Artificial sequence
  synthetic
VGNDT

SEQ ID NO: 1271 - protein, 5 aa, Artificial sequence
  synthetic
VGNET

SEQ ID NO: 1272 - protein, 5 aa, Artificial sequence
  synthetic
LGRLS

SEQ ID NO: 1273 - protein, 5 aa, Artificial sequence
  synthetic
RGPAA

SEQ ID NO: 1274 - protein, 5 aa, Artificial sequence
  synthetic
LTTAS

SEQ ID NO: 1275 - protein, 5 aa, Artificial sequence
  synthetic
MTTVM

SEQ ID NO: 1276 - protein, 6 aa, Artificial sequence
  synthetic
STENSK

SEQ ID NO: 1277 - protein, 5 aa, Artificial sequence
  synthetic
AGPLS

SEQ ID NO: 1278 - protein, 6 aa, Artificial sequence
  synthetic
KKMTGK

SEQ ID NO: 1279 - protein, 5 aa, Artificial sequence
  synthetic
KKMTG

SEQ ID NO: 1280 - protein, 5 aa, Artificial sequence
  synthetic
GRLSS

SEQ ID NO: 1281 - protein, 5 aa, Artificial sequence
  synthetic
ENSKM

SEQ ID NO: 1282 - protein, 5 aa, Artificial sequence
  synthetic
ESEKN

SEQ ID NO: 1283 - protein, 5 aa, Artificial sequence
  synthetic
RTQMK

SEQ ID NO: 1284 - protein, 5 aa, Artificial sequence
  synthetic
TQMKG

SEQ ID NO: 1285 - protein, 5 aa, Artificial sequence
  synthetic
QMKGP

SEQ ID NO: 1286 - protein, 15 aa, Artificial sequence
  synthetic
TGEAHNPKRAEDTYV

SEQ ID NO: 1287 - protein, 15 aa, Artificial sequence
  synthetic
KRAEDTYVCKSGVTD

SEQ ID NO: 1288 - protein, 15 aa, Artificial sequence
  synthetic
DTHGNYSSQLGASQA

SEQ ID NO: 1289 - protein, 15 aa, Artificial sequence
  synthetic
NYSSQLGASQAGRFT

SEQ ID NO: 1290 - protein, 15 aa, Artificial sequence
  synthetic
SPAITVKMGDYGEIS

SEQ ID NO: 1291 - protein, 15 aa, Artificial sequence
  synthetic
NGLNTEAYYIMSVGT

SEQ ID NO: 1292 - protein, 15 aa, Artificial sequence
  synthetic
PASSNWRNREILLEF

SEQ ID NO: 1293 - protein, 15 aa, Artificial sequence
  synthetic
SSNWRNREILLEFEE

SEQ ID NO: 1294 - protein, 15 aa, Artificial sequence
  synthetic
ATKQSVVALGSQEGA

SEQ ID NO: 1295 - protein, 15 aa, Artificial sequence
  synthetic
KNPADTGHGTVVLEL

SEQ ID NO: 1296 - protein, 15 aa, Artificial sequence
  synthetic
SDGPCKIPISIVASL

SEQ ID NO: 1297 - protein, 15 aa, Artificial sequence
  synthetic
SEANAKVLVEMEPPF

SEQ ID NO: 1298 - protein, 15 aa, Artificial sequence
  synthetic
DRYKFMPETPKQLAK

SEQ ID NO: 1299 - protein, 15 aa, Artificial sequence
  synthetic
VVVEKPKGMYKSAPQ

SEQ ID NO: 1300 - protein, 15 aa, Artificial sequence
  synthetic
FVVDGPETKECPDVK

SEQ ID NO: 1301 - protein, 15 aa, Artificial sequence
  synthetic
LKVREHNTTDCDSSI

SEQ ID NO: 1302 - protein, 15 aa, Artificial sequence
  synthetic
VTLAGPKSNHNRREG

SEQ ID NO: 1303 - protein, 15 aa, Artificial sequence
  synthetic
YKVQSQGPWDEEDIV

SEQ ID NO: 1304 - protein, 15 aa, Artificial sequence
  synthetic
GKRGPSIRTTTSSGR

SEQ ID NO: 1305 - protein, 15 aa, Artificial sequence
  synthetic
RGPSIRTTTSSGRLV

SEQ ID NO: 1306 - protein, 5 aa, Artificial sequence
  synthetic
CKRTL

SEQ ID NO: 1307 - protein, 5 aa, Artificial sequence
  synthetic
KRTLV

SEQ ID NO: 1308 - protein, 5 aa, Artificial sequence
  synthetic
RTLVD

SEQ ID NO: 1309 - protein, 5 aa, Artificial sequence
  synthetic
TLVDR

SEQ ID NO: 1310 - protein, 5 aa, Artificial sequence
  synthetic
LVDRG

SEQ ID NO: 1311 - protein, 5 aa, Artificial sequence
  synthetic
VDRGW

SEQ ID NO: 1312 - protein, 5 aa, Artificial sequence
  synthetic
DRGWG

SEQ ID NO: 1313 - protein, 5 aa, Artificial sequence
  synthetic
RGWGN

SEQ ID NO: 1314 - protein, 5 aa, Artificial sequence
  synthetic
GWGNG

SEQ ID NO: 1315 - protein, 5 aa, Artificial sequence
  synthetic
WGNGC

SEQ ID NO: 1316 - protein, 5 aa, Artificial sequence
  synthetic
GNGCG

SEQ ID NO: 1317 - protein, 5 aa, Artificial sequence
  synthetic
NGCGL

SEQ ID NO: 1318 - protein, 5 aa, Artificial sequence
  synthetic
GCGLF

SEQ ID NO: 1319 - protein, 5 aa, Artificial sequence
  synthetic
CGLFG

SEQ ID NO: 1320 - protein, 5 aa, Artificial sequence
  synthetic
YVCKH

SEQ ID NO: 1321 - protein, 5 aa, Artificial sequence
  synthetic
VCKHT

SEQ ID NO: 1322 - protein, 5 aa, Artificial sequence
  synthetic
CKHTY

SEQ ID NO: 1323 - protein, 5 aa, Artificial sequence
  synthetic
KHTYV

SEQ ID NO: 1324 - protein, 5 aa, Artificial sequence
  synthetic
HTYVD

SEQ ID NO: 1325 - protein, 5 aa, Artificial sequence
  synthetic
TYVDR

SEQ ID NO: 1326 - protein, 5 aa, Artificial sequence
  synthetic
YVDRG

SEQ ID NO: 1327 - protein, 5 aa, Artificial sequence
  synthetic
VDRGW

SEQ ID NO: 1328 - protein, 5 aa, Artificial sequence
  synthetic
GWGNG

SEQ ID NO: 1329 - protein, 5 aa, Artificial sequence
  synthetic
WGNGC

SEQ ID NO: 1330 - protein, 5 aa, Artificial sequence
  synthetic
GNGCG

SEQ ID NO: 1331 - protein, 5 aa, Artificial sequence
  synthetic
NGCGL

SEQ ID NO: 1332 - protein, 5 aa, Artificial sequence
  synthetic
GCGLF

SEQ ID NO: 1333 - protein, 5 aa, Artificial sequence
  synthetic
SSTSQ

SEQ ID NO: 1334 - protein, 5 aa, Artificial sequence
  synthetic
RREEE

SEQ ID NO: 1335 - protein, 5 aa, Artificial sequence
  synthetic
AAQKR

SEQ ID NO: 1336 - protein, 5 aa, Artificial sequence
  synthetic
RREEE

---

What is claimed is:

1. An isolated, non-naturally occurring Zika virus NS1 polypeptide having an amino acid sequence wherein the B-cell epitope STTAS (SEQ ID NO:702) is modified through deletion or mutation and is no longer capable of inducing a cross-reactive immune response with the human spindle-like microcephaly associated protein (ASPM).

2. The synthetic polypeptide of claim 1, wherein said NS1 polypeptide comprises an amino acid sequence selected from the group consisting of amino acids 21 to 384 of SEQ ID NO:441 and amino acids 21 to 213 of SEQ ID NO:445.

3. A fusion protein comprising the synthetic polypeptide sequences of claim 1.

4. The fusion protein of claim 3, wherein said fusion protein comprises a peptide sequence selected from the group consisting a signal sequence, a linker sequence, a purification tag sequence and an immunoglobulin sequence in operable association with said synthetic polypeptide, wherein said peptide sequence selected from the group consisting of a signal sequence, a linker sequence, a purification tag sequence and an immunoglobulin sequence is exogenous to said synthetic polypeptide sequence.

5. An immunogenic composition comprising a synthetic polypeptide of claim 1 and a pharmaceutically acceptable carrier.

6. The immunogenic composition of claim 5, further comprising an adjuvant.

* * * * *